US009670492B2

(12) United States Patent
Freier et al.

(10) Patent No.: US 9,670,492 B2
(45) Date of Patent: Jun. 6, 2017

(54) MODULATION OF PREKALLIKREIN (PKK) EXPRESSION

(71) Applicant: Ionis Pharmaceuticals, Inc., Carlsbad, CA (US)

(72) Inventors: Susan M. Freier, San Diego, CA (US); Huynh-Hoa Bui, San Diego, CA (US)

(73) Assignee: Ionis Pharmaceuticals, Inc., Carlsbad, CA (US)

( * ) Notice: Subject to any disclaimer, the term of this patent is extended or adjusted under 35 U.S.C. 154(b) by 0 days.

(21) Appl. No.: 14/915,039

(22) PCT Filed: Aug. 28, 2014

(86) PCT No.: PCT/US2014/053266
§ 371 (c)(1),
(2) Date: Feb. 26, 2016

(87) PCT Pub. No.: WO2015/031679
PCT Pub. Date: Mar. 5, 2015

(65) Prior Publication Data
US 2017/0002359 A1    Jan. 5, 2017

Related U.S. Application Data

(60) Provisional application No. 61/871,175, filed on Aug. 28, 2013.

(51) Int. Cl.
*C07H 21/02* (2006.01)
*C07H 21/04* (2006.01)
*A61K 31/70* (2006.01)
*C12N 15/113* (2010.01)
*A61K 31/7088* (2006.01)
*A61K 38/36* (2006.01)
*C12N 5/00* (2006.01)

(52) U.S. Cl.
CPC ...... *C12N 15/1137* (2013.01); *A61K 31/7088* (2013.01); *A61K 38/36* (2013.01); *C07H 21/04* (2013.01); *C12N 15/113* (2013.01); *C12N 2310/11* (2013.01); *C12N 2310/111* (2013.01); *C12N 2310/315* (2013.01); *C12N 2310/317* (2013.01); *C12N 2310/321* (2013.01); *C12N 2310/322* (2013.01); *C12N 2310/323* (2013.01); *C12N 2310/3231* (2013.01); *C12N 2310/3341* (2013.01); *C12N 2310/341* (2013.01); *C12N 2310/351* (2013.01); *C12N 2310/3525* (2013.01); *C12N 2320/31* (2013.01); *C12N 2320/35* (2013.01)

(58) Field of Classification Search
None
See application file for complete search history.

(56) References Cited

U.S. PATENT DOCUMENTS

| 4,153,687 A | 5/1979 | Schnabel et al. |
| 4,973,668 A | 11/1990 | Jallat et al. |
| 4,981,957 A | 1/1991 | Lebleu et al. |
| 5,034,506 A | 7/1991 | Summerton et al. |
| 5,118,800 A | 6/1992 | Smith et al. |
| 5,166,315 A | 11/1992 | Summerton et al. |
| 5,185,444 A | 2/1993 | Summerton et al. |
| 5,319,080 A | 6/1994 | Leumann |
| 5,359,044 A | 10/1994 | Cook et al. |
| 5,393,878 A | 2/1995 | Leumann |
| 5,446,137 A | 8/1995 | Maag et al. |
| 5,466,786 A | 11/1995 | Buhr et al. |
| 5,514,785 A | 5/1996 | Van Ness et al. |
| 5,519,134 A | 5/1996 | Acevedo et al. |
| 5,567,811 A | 10/1996 | Misiura et al. |
| 5,576,427 A | 11/1996 | Cook et al. |
| 5,591,722 A | 1/1997 | Montgomery et al. |
| 5,597,909 A | 1/1997 | Urdea et al. |
| 5,610,300 A | 3/1997 | Altmann et al. |
| 5,627,053 A | 5/1997 | Usman et al. |
| 5,639,873 A | 6/1997 | Barascut et al. |
| 5,646,265 A | 7/1997 | McGee |
| 5,670,633 A | 9/1997 | Cook et al. |
| 5,698,685 A | 12/1997 | Summerton et al. |
| 5,700,920 A | 12/1997 | Altmann et al. |
| 5,786,328 A | 7/1998 | Dennis et al. |
| 5,792,847 A | 8/1998 | Buhr et al. |
| 5,801,154 A | 9/1998 | Baracchini et al. |
| 6,268,490 B1 | 7/2001 | Imanishi et al. |
| 6,525,191 B1 | 2/2003 | Ramasamy |

(Continued)

FOREIGN PATENT DOCUMENTS

| WO | WO 94/14226 | 6/1994 |
| WO | WO 98/03665 | 1/1998 |

(Continued)

OTHER PUBLICATIONS

Albaek et al., "Analogues of a Locked Nucleic Acid with Three-Carbon 2',4'-Linkages: Synthesis by Ring-Closing Metathesis and Influence of Nucleic Acid Duplex Stability" J. Org. Chem. (2006) 71:7731-7740.
Altmann et al., "Second-generation antisense oligonucleoties: structure-activity relationships and the design of improved signal-transduction inhibitors" Biochem. Soc. Trans. (1996) 24: 630-637.
Altmann et al., "Second Generation of Antisense Oligonucleotides: From Nuclease Resistance to Biological Efficacy in Animals" Chimia (1996) 50: 168-176.
Altmann et al., "Second Generation Antisense Oligonucleotides—Inhibition of PKC-a and c-RAF Kinase Expression by Chimeric Oligonucleotides Incorporating 5'-Substituted Carbocyclic Nucleosides and 2'-O-Ethylene Glycol Substituted Ribonucleosides" Nucleosides Nucleotides (1997) 16(7-9): 917-926.
Altschul et al., "Basic Local Aligiment Search Tool" J. Mol. Biol. (1990) 215: 403-410.

(Continued)

Primary Examiner — Sean McGarry
(74) Attorney, Agent, or Firm — Ionis Pharmaceuticals, Inc. Patent Dept.

(57) ABSTRACT

Disclosed herein are antisense compounds and methods for decreasing PKK mRNA and protein expression. Such methods, compounds, and compositions are useful to treat, prevent, or ameliorate PKK-associated diseases, disorders, and conditions.

29 Claims, 2 Drawing Sheets

(56) References Cited

U.S. PATENT DOCUMENTS

| | | |
|---|---|---|
| 6,582,908 B2 | 6/2003 | Fodor et al. |
| 6,600,032 B1 | 7/2003 | Manoharan et al. |
| 6,670,461 B1 | 12/2003 | Wengel et al. |
| 6,770,748 B2 | 8/2004 | Imanishi et al. |
| 6,794,499 B2 | 9/2004 | Wengel et al. |
| 7,034,133 B2 | 4/2006 | Wengel et al. |
| 7,053,207 B2 | 5/2006 | Wengel |
| 7,235,530 B2 | 6/2007 | Blair et al. |
| 7,399,845 B2 | 7/2008 | Seth et al. |
| 7,427,672 B2 | 9/2008 | Imanishi et al. |
| 7,547,684 B2 | 6/2009 | Seth et al. |
| 7,691,997 B2 * | 4/2010 | Khvorova ............ A61K 31/713 536/24.5 |
| 7,696,345 B2 | 4/2010 | Allerson et al. |
| 7,741,457 B2 | 6/2010 | Seth et al. |
| 8,090,542 B2 | 1/2012 | Khvorova et al. |
| 9,315,811 B2 | 4/2016 | Bhattacharjee et al. |
| 9,322,021 B2 | 4/2016 | Revenko et al. |
| 2001/0053519 A1 | 12/2001 | Fodor et al. |
| 2003/0228597 A1 | 12/2003 | Cowsert et al. |
| 2004/0171570 A1 | 9/2004 | Allerson et al. |
| 2005/0089893 A1 | 4/2005 | Lopez et al. |
| 2005/0130923 A1 | 6/2005 | Bhat et al. |
| 2005/0221354 A1 | 10/2005 | Mounts et al. |
| 2005/0245475 A1 | 11/2005 | Khvorova et al. |
| 2005/0246794 A1 | 11/2005 | Khvorova et al. |
| 2005/0255487 A1 | 11/2005 | Khvorova et al. |
| 2005/0287570 A1 | 12/2005 | Mounts |
| 2006/0069020 A1 | 3/2006 | Blair et al. |
| 2006/0185027 A1 | 8/2006 | Bartel et al. |
| 2006/0264603 A1 | 11/2006 | Markland et al. |
| 2007/0031844 A1 | 2/2007 | Khvorova et al. |
| 2007/0039072 A1 | 2/2007 | Khvorova et al. |
| 2007/0191296 A1 | 8/2007 | Golz et al. |
| 2007/0207974 A1 | 9/2007 | Khvorova et al. |
| 2007/0253949 A1 | 11/2007 | Golz et al. |
| 2007/0287831 A1 | 12/2007 | Seth et al. |
| 2008/0039618 A1 | 2/2008 | Allerson et al. |
| 2008/0113351 A1 | 5/2008 | Naito et al. |
| 2008/0188409 A1 | 8/2008 | Blair et al. |
| 2008/0221031 A1 | 9/2008 | Blair et al. |
| 2008/0280811 A1 | 11/2008 | Feener et al. |
| 2009/0012281 A1 | 1/2009 | Swayze et al. |
| 2009/0067647 A1 | 3/2009 | Yoshizawa et al. |
| 2009/0075887 A1 | 3/2009 | McPherson |
| 2009/0100320 A1 | 4/2009 | Higgs et al. |
| 2009/0105142 A1 | 4/2009 | Moscicki |
| 2009/0221480 A1 | 9/2009 | Blair et al. |
| 2009/0227494 A1 | 9/2009 | Blair et al. |
| 2009/0227495 A1 | 9/2009 | Blair et al. |
| 2009/0233852 A1 | 9/2009 | Blair et al. |
| 2009/0234009 A1 | 9/2009 | Blair et al. |
| 2009/0247453 A1 | 10/2009 | Blair et al. |
| 2009/0264350 A1 | 10/2009 | Blair et al. |
| 2010/0029003 A1 | 2/2010 | Bartel et al. |
| 2010/0183625 A1 | 7/2010 | Sternlicht |
| 2011/0200611 A1 | 8/2011 | Sexton |
| 2011/0301215 A1 | 12/2011 | Sinha et al. |
| 2012/0052487 A9 | 3/2012 | Khvorova et al. |

FOREIGN PATENT DOCUMENTS

| | | |
|---|---|---|
| WO | WO 98/39352 | 9/1998 |
| WO | WO 99/14226 | 3/1999 |
| WO | WO 01/49687 | 7/2001 |
| WO | WO 03/004602 | 1/2003 |
| WO | WO 03/103475 | 12/2003 |
| WO | WO 2004/106356 | 12/2004 |
| WO | WO 2005/021570 | 3/2005 |
| WO | WO 2005/075665 | 8/2005 |
| WO | WO 2005/083110 | 9/2005 |
| WO | WO 2005/121371 | 12/2005 |
| WO | WO 2006/008002 | 1/2006 |
| WO | WO 2006/036860 | 4/2006 |
| WO | WO 2006/047842 | 5/2006 |
| WO | WO 2007/134181 | 11/2007 |
| WO | WO 2008/016883 | 2/2008 |
| WO | WO 2008/101157 | 8/2008 |
| WO | WO 2008/150729 | 12/2008 |
| WO | WO 2008/154401 | 12/2008 |
| WO | WO 2009/006478 | 1/2009 |
| WO | WO 2009/067647 | 5/2009 |
| WO | WO 2010/036696 | 4/2010 |
| WO | WO 2010/036698 | 4/2010 |
| WO | WO 2011/017521 | 2/2011 |
| WO | WO 2011/075684 | 6/2011 |
| WO | WO 2012/170945 | 12/2012 |
| WO | WO 2012/170947 | 12/2012 |
| WO | WO 2013/003808 | 1/2013 |
| WO | WO 2015/168532 | 11/2015 |

OTHER PUBLICATIONS

Baker et al., "2'-O-(2-Methoxy)ethyl-modified Anti-intercellular Adhesion Molecule 1 (ICAM-1) Oligonucleotides Selectively Increase the ICAM-1 mRNA Level and Inhibit Formation of the ICAM-1 Translation Initiation Complex in Human Umbilical Vein Endothelial Cells" J. Biol. Chem. (1997) 272(18): 11944-12000.

Bhattacharjee et al., "Inhibition of Vascular Permeability by Anti-sense-Mediated Inhibition of Plasma Kallikrein and Coagulation Factor 12" Nucleic Acid Therapeutics (2013) 23(3): 175-187.

Braasch et al., "Novel Antisense and Peptide Nucleic Acid Strategies for Controlling Gene Expression" Biochemistry (2002) 41(14): 4503-4510.

Braasch et al., "Locked nucleic acid (LNA): fine-tuning the recognition of DNA and RNA" Chem. Biol. (2001) 8:1-7.

Branch et al., "A good antisense molecule is hard to find," TIBS (1998) 23:45-50.

Chao et al., "Novel roles of kallistatin, a specific tissue kallikrein inhibitor, in vascular remodeling." Biol Chem (2001) 382(1): 15-21.

Chin "On the Preparation and Utilization of Isolated and Purified Oligonucleotides" Document purportedly located on a CD-ROM and contributed to the public collection of the Katherine R. Everett Law Library of the University of North Carolina on Mar. 14, 2002.

Cichon et al., "Increased activity of coagulation factor XII (Hageman factor) causes hereditary angioedema type III." Am. J. Hum. Genet. (2006) 79: 1098-1104.

Crooke et al., "Basic Principles of Anti sense Therapeutics" Antisense Research and Application (1998) Chapter 1:1-50.

Cruden et al., "Therapeutic Potential of Icatibant (HOE-140, JE-049)" Expert Opinion on Pharmacotherapy (2008) 9: 2383-90.

Cruz-Silva et al., "A proteinase inhibitor from Caesalpinia echinata (pau-brasil) seeds for plasma kallikrein, plasmin and factor XIIa." Biol Chem (2004) 385(11): 1083-1086.

Dias et al. "Antisense Oligonucletides: Basic Concepts and Mechanisms" mol Caner Ther (2002) 1:347-355.

Dowd, "Concomitant antiplatelet and anticoagulation therapy: Indications, controversies and practical advice" Plenary Sessions/Thrombosis Research (2008) 123, Supplement 1: S11-S15.

Evans et al., "Selective inhibitors of plasma kallikrein" Immunopharmacology (1996) 32(1-3): 115-116.

Freier et al., "The ups and downs of nucleic acid duplex stability: structure-stability studies on chemically-modified DNA:RNA duplexes" Nucleic Acids Research (1997) 25(22):4429-4443.

Frieden et al., "Expanding the design horizon of antisense oligonucleotides with alpha-L-LNA" Nucleic Acids Research (2003) 31(21):6365-6372.

Gallo et al., "Design and Applications of Modified Oligonucleotides" Braz J Med Biol Res. (2003) 36:143-151.

Gautschi et al., "Activity of a Novel bcl-2/bcl-xL-Bispecific Antisense Oligonucleotide Against Tumors of Diverse Histologic Origins" J. Natl. Cancer Inst. (2001) 93(6):463-471.

Gigli et al., "Interaction of plasma kallikrein with the C1 inhibitor." J. Immunol. (1970) 104:574-581.

Gonzalez et al., "Purification and preliminary characterization of a plasma kallikrein inhibitor isolated from sea hares Aplysia dactylomela Rang, 1828" Toxicon (2004) 43(2): 219-223.

(56) References Cited

OTHER PUBLICATIONS

Gu et al., "Base Pairing Properties of D- and L-Cyclohexene Nucleic Acids (CeNA)" Oligonucleotides (2003) 13(6): 479-489.
Gu et al., "Synthesis of enantiomeric-pure cyclohexenyl nucleoside building blocks for oligonucleotide synthesis" Tetrahedron (2004) 60(9): 2111-2123.
Gu et al., "Enzymatic Resolution and Base Pairing Properties of D- and L-Cyclohexenyl Nucleic Acids (CeNA)" Nucleosides, Nucleotides & Nucleic Acids (2005) 24(5-7): 993-998.
Han et al., "Increased vascular permeability in C1 inhibitor-deficient mice mediated by the bradykinin type 2 receptor." J. Clin. Invest. (2002) 109: 1057-1063.
Horvath et al., "Stereoselective synthesis of (-)-ara-cyclohexenyl-adenine" Tetrahedron Letters (2007) 48: 3621-3623.
Ikarugi et al., "Synergistic antithrombotic effect of a combination of NO donor and plasma kallikrein inhibitor." Thromb Res (2005) 116: 403-408.
Jones et al., "RNA Quantitation by Fluorescence-Based Solution Assay: RiboGreen Reagent Characterization," Analytical Biochemistry (1998) 265: 368-374.
Kaplan et al., "Pathways for bradykinin formation and inflammatory disease." J. Allergy Clin. Immunol. (2002) 109(2): 195-209.
Kim et al., "Pretreatment with nafamostat mesilate, a kallikrein inhibitor, to decrease withdrawal response associated with rocuronium" J. Anesth. (2010) 24(4): 549-552.
Koshkin et al., "LNA (Locked Nucleic Acids): Synthesis of the Adenine, Cytosine, Guanine, 5-Methylcytosine, Thymine and Uracil Biocyclonucleoside Monomers, Oligomerisation, and Unprecedented Nucleic Acid Recognition" Tetrahedron (1998) 54:3607-3630.
Kubitza et al., "Rivaroxaban (BAY 59/7939)—an oral, direct Factor Xa inhibitor—has no clinically relevant interaction with naproxen" Br. J. Clin. Pharmacol. (2006) 63(4): 469-476.
Kumar et al., "The First Analogues of LNA (Locked Nucleic Acids): Phosphorothioate-LNA and 2'-Thio-LNA" Bioorg. Med. Chem. Lett. (1998) 8:2219-2222.
Leumann, "DNA Analogues: From Supramolecular Principles to Biological Properties" Bioorganic & Medicinal Chemistry (2002) 10:841-854.
Leumann, "DNA Analogues: From Supramolecular Principles to Biological Properties" Bioorganic & Medicinal Chemistry (2002) 10:841-1954.
Lubberstedt et al., "HepaRC human hepatic cell line utility as a surrogate for primary human hepatocytes in drug metabolism assessment in vitro" Journal of Pharmacol. Methods (2011) 63: 59-68.
Mackenzie et al., "Plasma prekallikrein levels are positively associated with circulating lipid levels and the metabolic syndrome in children." Appl. Physiol. Nutr. Metab. (2010) 35: 518-525.
Maher et al., "Comparative hybrid arrest by tandem antisense oligodeoxyribonucleotides or oligodeoxyribonucleoside methylphosphonates in a cell-free system" Nuc. Acid. Res. (1988) 16:3341-3358.
Martin, "Ein neuer Zugang zu 2'-O-Alkylribonucleosiden und Eigenschaften eren Oligonucleotide" Helv. Chim. Acta (1995) 78: 486-504.
Morgan "Hereditary Angioedema-Therapies Old and New" New England Journal of Medicine (2010) 363: 581-83.
Nakane et al., "Nafamostat mesilate, a kallikrein inhibitor, prevents pain on injection with propofol" Br. J. Aneaesth. (1998) 81(6): 963-964.
Heinis et al., "Phage-encoded combinatorial chemical libraries based on bicyclic peptides." Nat Chem Biol (2009) 5(7): 502-507.
Nauwelaerts et al., "Structural characterization and biological evaluation of small interfering RNAs containing cyclohexenyl nucleosides." J. Am. Chem. Soc. (2007) 129(30): 9340-9348.
Nauwelaerts et al., "Cyclohexenyl nucleic acids: conformationally flexible oligonucleotides" Nucleic Acids Research (2005) 33(8): 2452-2463.
New England Biolabs 1998/99 Catalog (cover page and pp. 121 and 284).
Orum et al., "Locked nucleic acids: A promising molecular family for gene-function analysis and antisense drug development" Curr. Opinion Mol. Ther. (2001) 3(3):239-243.
Ravindran et al., "Inhibition of plasma kallikrein by C1-inhibitor: role of endothelial cells and the amino-terminal domain of C1-inhibitor." Thromb Haemost (2004) 92: 1277-1283.
Revenko et al., "Selective depletion of plasma prekallikrein or coagulation factor XII inhibits thrombosis in mice without increased risk of bleeding" Blood (2011) 118(19): 5302-5311.
Reynolds et al., "Rational siRNA design for RNA interference" Nature Biotechnology (2004) 22(3):326-330.
Riedl et al., "Response time for ecallantide treatment of acute hereditary angioedema attacks." Ann Allergy Asthma Immunol (2010) 105(6): 430-436.e2.
Robeyns et al., "Oligonucleotides with cyclohexene-nucleoside building blocks: crystallization and preliminary X-ray studies of a left-handed sequence GTGTACAC" Acta Crystallographica, Section F: Structural Biology and Crystallization Communications (2005) F61(6): 585-586.
Robeyns et al., "Structure of the Fully Modified Left-Handed Cyclohexene Nucleic Acid Sequence GTGTACAC" J. Am. Chem. Soc. (2008) 130(6): 1979-1984.
Sanghvi et al., "Heterocyclic Base Modifications in Nucleic Acids and Their Applications in Antisense Oligonucleotides" Antisense Research and Applications (1993) pp. 273-288.
Schneider et al., "Critical role of kalikrein in hereditary angioedema pathogenesis: a clinical trial of escallantide, a novel kallikrein inhibitor" J. Allery Clin. Immunol. (2007) 120(2):416-422.
Scott et al., "Alpha-1-antitrypsin-Pittsburgh. A potent inhibitor of human plasma factor XIa, kallikrein, and factor XIIf." J Clin Invest (1986) 77(2): 631-634.
Sexton et al., "Specific inhibition of tissue kallikrein 1 with a human monoclonal antibody reveals a potential role in airway diseases" Biochem J. (2009) 422: 383-392.
Singh et al., "LNA (locked nucleic acids): synthesis and high-affinity nucleic acid recognition" Chem. Commun. (1998) 4:455-456.
Singh et al., "Synthesis of 2'-Amino-LNA: A Novel Conformationally Restricted High-Affinity Oligonucleotide Analogue with a Handle" J. Org. Chem. (1998) 63:10035-10039.
Srivastava et al., "Five- and Six-Membered Conformationally Locked 2',4'-Carbocyclic ribo-Thymidines: Synthesis, Structure, and Biochemical Studies" J. Am. Che,. Soc. (2007) 129:8362-8379.
Stolz et al., "Ecallantide: a plasma kallikrein inhibitor for the treatment of acute attacks of hereditary angioedema." Drugs Today (2010) 46(8): 547-555.
Stoop et al., "Analysis of an engineered plasma kallikrein inhibitor and its effect on contact activation" Biol Chem 2010; 391(4): 425-433.
Verbeure et al., "RNase H mediated cleavage of RNA by cyclohexene nucleic acid (CeNA)" Nucleic Acids Research (2001) 29(24): 4941-4947.
Wahlestedt et al., "Potent and nontoxic antisense oligonucleoties containing locked nucleic acids" PNAS (2000) 97(10):5633-5638.
Wang et al., "Cyclohexene Nucleic Acids (CeNA): Serum Stable Oligonucleotides that Activate RNase H and Increase Duplex Stability with Complementary RNA" J. Am. Chem. (2000) 122: 8595-8602.
Wang et al., "A Straightforward Stereoselective Synthesis of D- and L-5-Hydroxy-4-hydroxymethyl-2-cyclohexenylguanine" J. Org. Chem. (2001) 66: 8478-8482.
Wang et al., "Stereocontrolled Synthesis of Ara-Type Cyclohexenyl Nucleosides" J. Org. Chem. (2003) 68: 4499-4505.
Wang et al., "Cyclohexene Nucleic Acids (CcNA) Form Stable Duplexes With RNA and Induce RNASE H Activity" Nucleosides, Nucleotides & Nucleic Acids (2001) 20(4-7), 785-788.
Wong et al. "Arterial antithrombotic and bleeding time effects of apixaban, a direct factor Xa inhibitor, in combination with antiplatelet therapy in rabbits" Journal of Thrombosis and Haemostasis (2008) 6: 1736-1741.

(56) References Cited

OTHER PUBLICATIONS

Wolf et al., "A synthetic tissue kallikrein inhibitor suppresses cancer cell invasiveness." Ant J Pathol (2001) 159: 1797-1805.

Woolf et al., "Specificity of antisense oligonucleotides in vivo" PNAS (1992) 89:7305-7309.

Zhang e al., "PowerBLAST: A New Network Blast Application for Interactive or Automate Sequence Analysis and Annoation", Genome Res. (1997) 7: 649-656.

Wulf et al., "CU-2010—A Novel Small Molecule Protease Inhibitor with Antifibrinolytic and Anticoagulant Properties" Anesthesiology (2009) 110(1): 123-130.

Zhou et al., "Kallistatin: a novel human tissue kallikrein inhibitor. Purification, characterization, and reactive center sequence." J. Biol. Chem. (1992) 267(36): 25873-25880.

Zhou et al., "Fine Tuning of Electrostatics around the Internucleoside Phosphate through Incorporation of Modified 2',4'-Carbocylic-LNAs and -ENAs Leads to Significant Modulation of Antisense Properties" J. Org. Chem. (2009) 74: 118-134.

Zuraw, "Hereditary Angioedema" N. Engl. J. Med. (2008) 359: 1027-36.

European Search Report for application EP 12804096.1 dated Dec. 15, 2014.

European Search Report for application EP 12796547.3 dated Nov. 14, 2014.

International Search Report for application PCT/US12/45105 dated Sep. 25, 2012.

International Search Report for application PCT/US12/41743 dated Nov. 20, 2012.

International Search Report for application PCT/US15/28765 dated Jan. 27, 2016.

International Search Report for application PCT/US14/053266 dated Feb. 25, 2015.

Xu et al., "Effective small interfering RNAs and phosphorothioate antisense DNAs have different preferences for target site in the luciferase mRNAs," Biochemical and Biophysical Research Communications (2003) 306: 712-717.

\* cited by examiner

MODULATION OF PREKALLIKREIN (PKK) EXPRESSION

SEQUENCE LISTING

The present application is being filed along with a Sequence Listing in electronic format. The Sequence Listing is provided as a file entitled BIOL0172USASEQ_ST25.txt created Feb. 25, 2016, which is approximately 632 KB in size. The information in the electronic format of the sequence listing is incorporated herein by reference in its entirety.

FIELD

Provided are compounds, compositions, and methods for reducing expression of human plasma prekallikrein (PKK) mRNA and protein in an animal. Such compositions and methods are useful to treat, prevent, or ameliorate inflammatory and thromboembolic conditions.

BACKGROUND

Plasma prekallikrein (PKK) is the precursor of plasma kallikrein (PK), which is encoded by the KLKB1 gene. PKK is a glycoprotein that participates in the surface-dependent activation of blood coagulation, fibrinolysis, kinin generation, and inflammation. PKK is converted to PK by Factor XIIa by the cleavage of an internal Arg-Ile peptide bond. PK liberates kinins from kininogens and also generates plasmin from plasminogen. PK is a member of the kinin-kallikrein pathway, which consists of several proteins that play a role in inflammation, blood pressure control, coagulation, and pain.

SUMMARY

Provided herein are compounds, compositions, and methods for modulating expression of PKK mRNA and protein. In certain embodiments, compounds useful for modulating expression of PKK mRNA and protein are antisense compounds. In certain embodiments, the antisense compounds are antisense oligonucleotides.

In certain embodiments, modulation can occur in a cell or tissue. In certain embodiments, the cell or tissue is in an animal. In certain embodiments, the animal is a human. In certain embodiments, PKK mRNA levels are reduced. In certain embodiments, PKK protein levels are reduced. Such reduction can occur in a time-dependent manner or in a dose-dependent manner.

Also provided are compounds, compositions, and methods useful for preventing, treating, and ameliorating diseases, disorders, and conditions associated with PKK. In certain embodiments, such PKK associated diseases, disorders, and conditions are inflammatory diseases. In certain embodiments, the inflammatory disease may be an acute or chronic inflammatory disease. In certain embodiments, such inflammatory diseases may include hereditary angioedema (HAE), edema, angioedema, swelling, angioedema of the lids, ocular edema, macular edema, and cerebral edema. In certain embodiments, such PKK associated diseases, disorders, and conditions are thromboembolic diseases. In certain embodiments, such thromboembolic diseases may include thrombosis, embolism, thromboembolism, deep vein thrombosis, pulmonary embolism, myocardial infarction, stroke, and infarct.

Such diseases, disorders, and conditions can have one or more risk factors, causes, or outcomes in common.

Certain risk factors and causes for development of an inflammatory disease include genetic predisposition to an inflammatory disease and environmental factors. In certain embodiments, the subject has a mutated complement 1 esterase inhibitor (C1-INH) gene or mutated Factor 12 gene. In certain embodiments, the subject has taken or is on angiotensin-converting enzyme inhibitors (ACE inhibitors) or angiotensin II receptor blockers (ARBs). In certain embodiments, the subject has had an allergic reaction leading to angioedema. In certain embodiments, the subject has type I HAE. In certain embodiments, the subject has type II HAE. In certain embodiments, the subject has type III HAE.

Certain outcomes associated with development of an inflammatory disease include edema/swelling in various body parts including the extremities (i.e., hands, feet, arms, legs), the intestines (abdomen), the face, the genitals, the larynx (i.e., voice box); vascular permeability; vascular leakage; generalized inflammation; abdominal pain; bloating; vomiting; diarrhea; itchy skin; respiratory (asthmatic) reactions; rhinitis; anaphylaxis; bronchoconstriction; hypotension; coma; and death.

Certain risk factors and causes for development of a thromboembolic disease include genetic predisposition to a thromboembolic disease, immobility, surgery (particularly orthopedic surgery), malignancy, pregnancy, older age, use of oral contraceptives, atrial fibrillation, previous thromboembolic condition, chronic inflammatory disease, and inherited or acquired prothrombotic clotting disorders. Certain outcomes associated with development of a thromboembolic condition include decreased blood flow through an affected vessel, death of tissue, and death.

In certain embodiments, methods of treatment include administering a PKK antisense compound to an individual in need thereof. In certain embodiments, methods of treatment include administering a PKK antisense oligonucleotide to an individual in need thereof.

LISTING OF FIGURES

DETAILED DESCRIPTION

Figure 1:
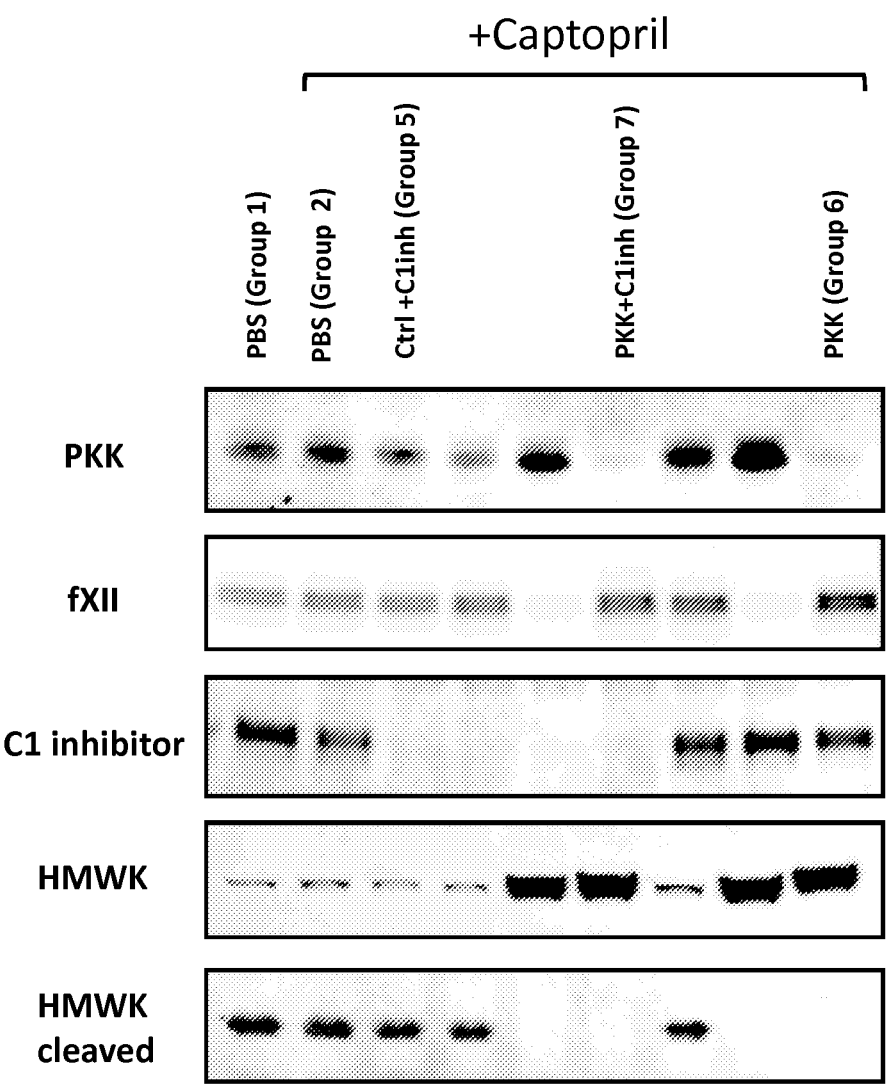
FIG. 1 is a Western blot quantification of HMWK from blood samples as described in Example 11.

It is to be understood that both the foregoing general description and the following detailed description are exemplary and explanatory only and are not restrictive of the invention, as claimed. Herein, the use of the singular includes the plural unless specifically stated otherwise. As used herein, the use of "or" means "and/or" unless stated otherwise. Furthermore, the use of the term "including" as well as other forms, such as "includes" and "included", is not limiting. Also, terms such as "element" or "component" encompass both elements and components comprising one unit and elements and components that comprise more than one subunit, unless specifically stated otherwise.

The section headings used herein are for organizational purposes only and are not to be construed as limiting the subject matter described. All documents, or portions of documents, cited in this application, including, but not limited to, patents, patent applications, articles, books, and

DEFINITIONS

Unless specific definitions are provided, the nomenclature utilized in connection with, and the procedures and techniques of, analytical chemistry, synthetic organic chemistry, and medicinal and pharmaceutical chemistry described herein are those well known and commonly used in the art. Standard techniques may be used for chemical synthesis, and chemical analysis. Where permitted, all patents, applications, published applications and other publications, GENBANK Accession Numbers and associated sequence information obtainable through databases such as National Center for Biotechnology Information (NCBI) and other data referred to throughout in the disclosure herein are incorporated by reference for the portions of the document discussed herein, as well as in their entirety.

Unless otherwise indicated, the following terms have the following meanings:

"2'-O-methoxyethyl" (also 2'-MOE and 2'-OCH$_2$CH$_2$—OCH$_3$ and MOE) refers to an O-methoxyethyl modification of the 2' position of a furanose ring. A 2'-O-methoxyethyl modified sugar is a modified sugar.

"2'-O-methoxyethyl modified nucleoside" (also "2'-MOE nucleoside") means a nucleoside comprising a 2'-MOE modified sugar moiety.

"2'-substituted nucleoside" means a nucleoside comprising a substituent at the 2'-position of the furanose ring other than H or OH. In certain embodiments, 2' substituted nucleosides include nucleosides with bicyclic sugar modifications.

"2'-deoxynucleoside" means a nucleoside comprising a hydrogen at the 2' position of the sugar portion of the nucleoside.

"3' target site" refers to the nucleotide of a target nucleic acid which is complementary to the 3'-most nucleotide of a particular antisense compound.

"5' target site" refers to the nucleotide of a target nucleic acid which is complementary to the 5'-most nucleotide of a particular antisense compound.

"5-methylcytosine" means a cytosine modified with a methyl group attached to the 5 position. A 5-methylcytosine is a modified nucleobase.

"About" means within ±7% of a value. For example, if it is stated, "the compounds affected at least about 70% inhibition of PKK", it is implied that the PKK levels are inhibited within a range of 63% and 77%.

"Administered concomitantly" refers to the co-administration of two pharmaceutical agents in any manner in which the pharmacological effects of both are manifest in the patient at the same time. Concomitant administration does not require that both pharmaceutical agents be administered in a single pharmaceutical composition, in the same dosage form, or by the same route of administration. The effects of both pharmaceutical agents need not manifest themselves at the same time. The effects need only be overlapping for a period of time and need not be coextensive.

"Administering" means providing a pharmaceutical agent to an animal, and includes, but is not limited to administering by a medical professional and self-administering.

"Amelioration" refers to a lessening, slowing, stopping, or reversing of at least one indicator of the severity of a condition or disease. The severity of indicators may be determined by subjective or objective measures, which are known to those skilled in the art.

"Animal" refers to a human or non-human animal, including, but not limited to, mice, rats, rabbits, dogs, cats, pigs, and non-human primates, including, but not limited to, monkeys and chimpanzees.

"Antisense activity" means any detectable or measurable activity attributable to the hybridization of an antisense compound to its target nucleic acid. In certain embodiments, antisense activity is a decrease in the amount or expression of a target nucleic acid or protein encoded by such target nucleic acid. "Antisense compound" means an oligomeric compound that is capable of undergoing hybridization to a target nucleic acid through hydrogen bonding. Examples of antisense compounds include single-stranded and double-stranded compounds, such as, antisense oligonucleotides, siRNAs, shRNAs, ssRNAs, and occupancy-based compounds.

"Antisense compound" means an oligomeric compound that is capable of undergoing hybridization to a target nucleic acid through hydrogen bonding. Examples of antisense compounds include single-stranded and double-stranded compounds, such as, antisense oligonucleotides, siRNAs, shRNAs, ssRNAs, and occupancy-based compounds.

"Antisense inhibition" means reduction of target nucleic acid levels in the presence of an antisense compound complementary to a target nucleic acid compared to target nucleic acid levels or in the absence of the antisense compound. "Antisense mechanisms" are all those mechanisms involving hybridization of a compound with target nucleic acid, wherein the outcome or effect of the hybridization is either target degradation or target occupancy with concomitant stalling of the cellular machinery involving, for example, transcription or splicing.

"Antisense mechanisms" are all those mechanisms involving hybridization of a compound with a target nucleic acid, wherein the outcome or effect of the hybridization is either target degradation or target occupancy with concomitant stalling of the cellular machinery involving, for example, transcription or splicing.

"Antisense oligonucleotide" means a single-stranded oligonucleotide having a nucleobase sequence that permits hybridization to a corresponding segment of a target nucleic acid. "Base complementarity" refers to the capacity for the precise base pairing of nucleobases of an antisense oligonucleotide with corresponding nucleobases in a target nucleic acid (i.e., hybridization), and is mediated by Watson-Crick, Hoogsteen or reversed Hoogsteen hydrogen binding between corresponding nucleobases.

"Base complementarity" refers to the capacity for the precise base pairing of nucleobases of an antisense oligonucleotide with corresponding nucleobases in a target nucleic acid (i.e., hybridization), and is mediated by Watson-Crick, Hoogsteen or reversed Hoogsteen hydrogen binding between corresponding nucleobases.

"Bicyclic sugar" means a furanose ring modified by the bridging of two atoms. A bicyclic sugar is a modified sugar.

"Bicyclic nucleoside" (also bicyclic nucleic acid or BNA) means a nucleoside having a sugar moiety comprising a bridge connecting two carbon atoms of the sugar ring, thereby forming a bicyclic ring system. In certain embodiments, the bridge connects the 4'-carbon and the 2'-carbon of the sugar ring.

"Cap structure" or "terminal cap moiety" means chemical modifications, which have been incorporated at either terminus of an antisense compound.

"cEt" or "constrained ethyl" means a bicyclic nucleoside having a sugar moiety comprising a bridge connecting the 4'-carbon and the 2'-carbon, wherein the bridge has the formula: 4'-CH(CH$_3$)—O-2'.

"cEt modified nucleoside" (also "constrained ethyl nucleoside") means a nucleoside comprising a bicyclic sugar moiety comprising a 4'-CH(CH$_3$)—O-2' bridge.

"Chemically distinct region" refers to a region of an antisense compound that is in some way chemically different than another region of the same antisense compound. For example, a region having 2'-O-methoxyethyl nucleosides is chemically distinct from a region having nucleosides without 2'-O-methoxyethyl modifications.

"Chimeric antisense compound" means an antisense compound that has at least two chemically distinct regions, each position having a plurality of subunits.

"Co-administration" means administration of two or more pharmaceutical agents to an individual. The two or more pharmaceutical agents may be in a single pharmaceutical composition, or may be in separate pharmaceutical compositions. Each of the two or more pharmaceutical agents may be administered through the same or different routes of administration. Co-administration encompasses parallel or sequential administration.

"Complementarity" means the capacity for pairing between nucleobases of a first nucleic acid and a second nucleic acid.

"Comprise," "comprises," and "comprising" will be understood to imply the inclusion of a stated step or element or group of steps or elements but not the exclusion of any other step or element or group of steps or elements.

"Contiguous nucleobases" means nucleobases immediately adjacent to each other.

"Designing" or "Designed to" refer to the process of creating an oligomeric compound that specifically hybridizes with a selected nucleic acid molecule.

"Diluent" means an ingredient in a composition that lacks pharmacological activity, but is pharmaceutically necessary or desirable. For example, in drugs that are injected, the diluent may be a liquid, e.g. saline solution.

"Dose" means a specified quantity of a pharmaceutical agent provided in a single administration, or in a specified time period. In certain embodiments, a dose may be administered in one, two, or more boluses, tablets, or injections. For example, in certain embodiments where subcutaneous administration is desired, the desired dose requires a volume not easily accommodated by a single injection, therefore, two or more injections may be used to achieve the desired dose. In certain embodiments, the pharmaceutical agent is administered by infusion over an extended period of time or continuously. Doses may be stated as the amount of pharmaceutical agent per hour, day, week, or month.

"Downstream" refers to the relative direction toward the 3' end or C-terminal end of a nucleic acid.

"Effective amount" in the context of modulating an activity or of treating or preventing a condition means the administration of that amount of pharmaceutical agent to a subject in need of such modulation, treatment, or prophylaxis, either in a single dose or as part of a series, that is effective for modulation of that effect, or for treatment or prophylaxis or improvement of that condition. The effective amount may vary among individuals depending on the health and physical condition of the individual to be treated, the taxonomic group of the individuals to be treated, the formulation of the composition, assessment of the individual's medical condition, and other relevant factors.

"Efficacy" means the ability to produce a desired effect.

"Expression" includes all the functions by which a gene's coded information is converted into structures present and operating in a cell. Such structures include, but are not limited to the products of transcription and translation.

"Fully complementary" or "100% complementary" means each nucleobase of a first nucleic acid has a complementary nucleobase in a second nucleic acid. In certain embodiments, a first nucleic acid is an antisense compound and a target nucleic acid is a second nucleic acid.

"Gapmer" means a chimeric antisense compound in which an internal region having a plurality of nucleosides that support RNase H cleavage is positioned between external regions having one or more nucleosides, wherein the nucleosides comprising the internal region are chemically distinct from the nucleoside or nucleosides comprising the external regions. The internal region may be referred to as a "gap" and the external regions may be referred to as the "wings."

"Hybridization" means the annealing of complementary nucleic acid molecules. In certain embodiments, complementary nucleic acid molecules include, but are not limited to, an antisense compound and a target nucleic acid. In certain embodiments, complementary nucleic acid molecules include, but are not limited to, an antisense oligonucleotide and a nucleic acid target.

"Identifying an animal having an inflammatory disease" means identifying an animal having been diagnosed with an inflammatory disease or predisposed to develop an inflammatory disease. Individuals predisposed to develop an inflammatory disease include those having one or more risk factors for developing an inflammatory disease including environmental factors, having a personal or family history, or genetic predisposition to one or more inflammatory disease. Such identification may be accomplished by any method including evaluating an individual's medical history and standard clinical tests or assessments, such as genetic testing.

"Identifying an animal having a PKK associated disease" means identifying an animal having been diagnosed with a PKK associated disease or predisposed to develop a PKK associated disease. Individuals predisposed to develop a PKK associated disease include those having one or more risk factors for developing a PKK associated disease including having a personal or family history, or genetic predisposition of one or more PKK associated diseases. Such identification may be accomplished by any method including evaluating an individual's medical history and standard clinical tests or assessments, such as genetic testing.

"Identifying an animal having a thromboembolic disease" means identifying an animal having been diagnosed with a thromboembolic disease or predisposed to develop a thromboembolic disease. Individuals predisposed to develop a thromboembolic disease include those having one or more risk factors for developing a thromboembolic disease including having a personal or family history, or genetic predisposition of one or more thromboembolic diseases, immobility, surgery (particularly orthopedic surgery), malignancy, pregnancy, older age, use of oral contraceptives, atrial fibrillation, previous thromboembolic condition, chronic inflammatory disease, and inherited or acquired prothrombotic clotting disorders. Such identification may be accomplished by any method including evaluating an individual's medical history and standard clinical tests or assessments, such as genetic testing.

"Immediately adjacent" means there are no intervening elements between the immediately adjacent elements. "Individual" means a human or non-human animal selected for treatment or therapy.

"Individual" means a human or non-human animal selected for treatment or therapy.

"Inhibiting PKK" means reducing the level or expression of a PKK mRNA and/or protein. In certain embodiments, PKK mRNA and/or protein levels are inhibited in the presence of an antisense compound targeting PKK, including an antisense oligonucleotide targeting PKK, as compared to expression of PKK mRNA and/or protein levels in the absence of a PKK antisense compound, such as an antisense oligonucleotide.

"Inhibiting the expression or activity" refers to a reduction or blockade of the expression or activity and does not necessarily indicate a total elimination of expression or activity.

"Internucleoside linkage" refers to the chemical bond between nucleosides.

"Linked nucleosides" means adjacent nucleosides linked together by an internucleoside linkage.

"Locked nucleic acid" or "LNA" or "LNA nucleosides" means nucleic acid monomers having a bridge connecting two carbon atoms between the 4' and 2' position of the nucleoside sugar unit, thereby forming a bicyclic sugar. Examples of such bicyclic sugar include, but are not limited to A) α-L-Methyleneoxy (4'-CH$_2$—O-2') LNA, (B) β-D-Methyleneoxy (4'-CH$_2$—O-2') LNA, (C) Ethyleneoxy (4'-(CH$_2$)$_2$—O-2') LNA, (D) Aminooxy (4'-CH$_2$—O—N(R)-2') LNA and (E) Oxyamino (4'-CH$_2$—N(R)—O-2') LNA, as depicted below.

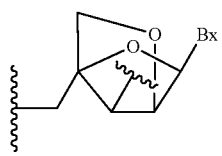
(A)

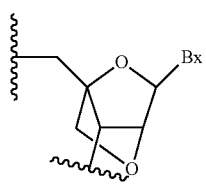
(B)

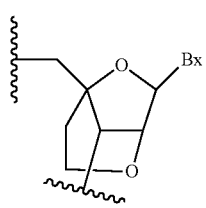
(C)

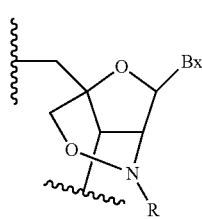
(D)

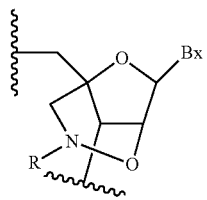
(E)

As used herein, LNA compounds include, but are not limited to, compounds having at least one bridge between the 4' and the 2' position of the sugar wherein each of the bridges independently comprises 1 or from 2 to 4 linked groups independently selected from —[C(R$_1$)(R$_2$)]$_n$—, —C(R$_1$)=C(R$_2$)—, —C(R$_1$)=N—, —C(=NR$_1$)—, —C(=O)—, —C(=S)—, —O—, —Si(R$_1$)$_2$—, —S(=O)$_x$— and —N(R$_1$)—; wherein: x is 0, 1, or 2; n is 1, 2, 3, or 4; each R$_1$ and R$_2$ is, independently, H, a protecting group, hydroxyl, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, a heterocycle radical, a substituted heterocycle radical, heteroaryl, substituted heteroaryl, C$_5$-C$_7$ alicyclic radical, substituted C$_5$-C$_7$ alicyclic radical, halogen, OJ$_1$, NJ$_1$J$_2$, SJ$_1$, N$_3$, COOJ$_1$, acyl (C(=O)—H), substituted acyl, CN, sulfonyl (S(=O)$_2$-J$_1$), or sulfoxyl (S(=O)-J$_1$); and each J$_1$ and J$_2$ is, independently, H, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, acyl (C(=O)—H), substituted acyl, a heterocycle radical, a substituted heterocycle radical, C$_1$-C$_{12}$ aminoalkyl, substituted C$_1$-C$_{12}$ aminoalkyl or a protecting group.

Examples of 4'-2' bridging groups encompassed within the definition of LNA include, but are not limited to one of formulae: —[C(R$_1$)(R$_2$)]$_n$—, —[C(R$_1$)(R$_2$)]$_n$—O—, —C(R$_1$R$_2$)—N(R$_1$)—O— or —C(R$_1$R$_2$)—O—N(R$_1$)—. Furthermore, other bridging groups encompassed with the definition of LNA are 4'-CH$_2$-2', 4'-(CH$_2$)$_2$-2', 4'-(CH$_2$)$_3$-2', 4'-CH$_2$—O-2', 4'-(CH$_2$)$_2$—O-2', 4'-CH$_2$—O—N(R$_1$)-2' and 4'-CH$_2$—N(R$_1$)—O-2'-bridges, wherein each R$_1$ and R$_2$ is, independently, H, a protecting group or C$_1$-C$_{12}$ alkyl.

Also included within the definition of LNA according to the invention are LNAs in which the 2'-hydroxyl group of the ribosyl sugar ring is connected to the 4' carbon atom of the sugar ring, thereby forming a methyleneoxy (4'-CH$_2$—O-2') bridge to form the bicyclic sugar moiety. The bridge can also be a methylene (—CH$_2$—) group connecting the 2' oxygen atom and the 4' carbon atom, for which the term methyleneoxy (4'-CH$_2$—O-2') LNA is used. Furthermore; in the case of the bicyclic sugar moiety having an ethylene bridging group in this position, the term ethyleneoxy (4'-CH$_2$CH$_2$—O-2') LNA is used. α-L-methyleneoxy (4'-CH$_2$—O-2'), an isomer of methyleneoxy (4'-CH$_2$—O-2') LNA is also encompassed within the definition of LNA, as used herein.

"Mismatch" or "non-complementary nucleobase" refers to the case when a nucleobase of a first nucleic acid is not capable of pairing with the corresponding nucleobase of a second or target nucleic acid.

"Modified internucleoside linkage" refers to a substitution or any change from a naturally occurring internucleoside bond (i.e. a phosphodiester internucleoside bond).

"Modified nucleobase" means any nucleobase other than adenine, cytosine, guanine, thymidine (also known as 5-methyluracil), or uracil. An "unmodified nucleobase"

means the purine bases adenine (A) and guanine (G), and the pyrimidine bases thymine (T), cytosine (C), and uracil (U).

"Modified nucleoside" means a nucleoside having, independently, a modified sugar moiety and/or modified nucleobase.

"Modified nucleotide" means a nucleotide having, independently, a modified sugar moiety, modified internucleoside linkage, and/or modified nucleobase.

"Modified oligonucleotide" means an oligonucleotide comprising at least one modified internucleoside linkage, modified sugar, and/or modified nucleobase.

"Modified sugar" means substitution and/or any change from a natural sugar moiety.

"Monomer" means a single unit of an oligomer. Monomers include, but are not limited to, nucleosides and nucleotides, whether naturally occurring or modified.

"Motif" means the pattern of unmodified and modified nucleosides in an antisense compound.

"Natural sugar moiety" means a sugar moiety found in DNA (2'-H) or RNA (2'-OH).

"Naturally occurring internucleoside linkage" means a 3' to 5' phosphodiester linkage.

"Non-complementary nucleobase" refers to a pair of nucleobases that do not form hydrogen bonds with one another or otherwise support hybridization.

"Nucleic acid" refers to molecules composed of monomeric nucleotides. A nucleic acid includes, but is not limited to, ribonucleic acids (RNA), deoxyribonucleic acids (DNA), single-stranded nucleic acids, double-stranded nucleic acids, small interfering ribonucleic acids (siRNA), and microRNAs (miRNA).

"Nucleobase" means a heterocyclic moiety capable of pairing with a base of another nucleic acid.

"Nucleobase complementarity" refers to a nucleobase that is capable of base pairing with another nucleobase. For example, in DNA, adenine (A) is complementary to thymine (T). For example, in RNA, adenine (A) is complementary to uracil (U). In certain embodiments, complementary nucleobase refers to a nucleobase of an antisense compound that is capable of base pairing with a nucleobase of its target nucleic acid. For example, if a nucleobase at a certain position of an antisense compound is capable of hydrogen bonding with a nucleobase at a certain position of a target nucleic acid, then the position of hydrogen bonding between the oligonucleotide and the target nucleic acid is considered to be complementary at that nucleobase pair.

"Nucleobase sequence" means the order of contiguous nucleobases independent of any sugar, linkage, and/or nucleobase modification.

"Nucleoside" means a nucleobase linked to a sugar.

"Nucleoside mimetic" includes those structures used to replace the sugar or the sugar and the base and not necessarily the linkage at one or more positions of an oligomeric compound such as for example nucleoside mimetics having morpholino, cyclohexenyl, cyclohexyl, tetrahydropyranyl, bicyclo, or tricyclo sugar mimetics, e.g., non furanose sugar units. Nucleotide mimetic includes those structures used to replace the nucleoside and the linkage at one or more positions of an oligomeric compound such as for example peptide nucleic acids or morpholinos (morpholinos linked by —N(H)—C(=O)—O— or other non-phosphodiester linkage). Sugar surrogate overlaps with the slightly broader term nucleoside mimetic but is intended to indicate replacement of the sugar unit (furanose ring) only. The tetrahydropyranyl rings provided herein are illustrative of an example of a sugar surrogate wherein the furanose sugar group has been replaced with a tetrahydropyranyl ring system.

"Mimetic" refers to groups that are substituted for a sugar, a nucleobase, and/or internucleoside linkage. Generally, a mimetic is used in place of the sugar or sugar-internucleoside linkage combination, and the nucleobase is maintained for hybridization to a selected target.

"Nucleotide" means a nucleoside having a phosphate group covalently linked to the sugar portion of the nucleoside.

"Off-target effect" refers to an unwanted or deleterious biological effect associated with modulation of RNA or protein expression of a gene other than the intended target nucleic acid.

"Oligomeric compound" or "oligomer" means a polymer of linked monomeric subunits which is capable of hybridizing to at least a region of a nucleic acid molecule.

"Oligonucleotide" means a polymer of linked nucleosides each of which can be modified or unmodified, independent one from another.

"Parenteral administration" means administration through injection (e.g., bolus injection) or infusion. Parenteral administration includes subcutaneous administration, intravenous administration, intramuscular administration, intraarterial administration, intraperitoneal administration, or intracranial administration, e.g., intrathecal or intracerebroventricular administration.

"Peptide" means a molecule formed by linking at least two amino acids by amide bonds. Without limitation, as used herein, peptide refers to polypeptides and proteins.

"Pharmaceutical agent" means a substance that provides a therapeutic benefit when administered to an individual. For example, in certain embodiments, an antisense oligonucleotide targeted to PKK is a pharmaceutical agent.

"Pharmaceutical composition" means a mixture of substances suitable for administering to a subject. For example, a pharmaceutical composition may comprise an antisense oligonucleotide and a sterile aqueous solution.

"Pharmaceutically acceptable derivative" encompasses pharmaceutically acceptable salts, conjugates, prodrugs or isomers of the compounds described herein.

"Pharmaceutically acceptable salts" means physiologically and pharmaceutically acceptable salts of antisense compounds, i.e., salts that retain the desired biological activity of the parent oligonucleotide and do not impart undesired toxicological effects thereto.

"Phosphorothioate linkage" means a linkage between nucleosides where the phosphodiester bond is modified by replacing one of the non-bridging oxygen atoms with a sulfur atom. A phosphorothioate linkage is a modified internucleoside linkage.

"PKK" means mammalian plasma prekallikrein, including human plasma prekallikrein. Plasma prekallikrein (PKK) is the precursor of plasma kallikrein (PK), which is encoded by the KLKB1 gene.

"PKK associated disease" means any disease associated with any PKK nucleic acid or expression product thereof. Such diseases may include an inflammatory disease or a thromboembolic disease. Such diseases may include hereditary angioedema (HAE).

"PKK mRNA" means any messenger RNA expression product of a DNA sequence encoding PKK.

"PKK nucleic acid" means any nucleic acid encoding PKK. For example, in certain embodiments, a PKK nucleic acid includes a DNA sequence encoding PKK, an RNA sequence transcribed from DNA encoding PKK (including genomic DNA comprising introns and exons), and an mRNA sequence encoding PKK. "PKK mRNA" means an mRNA encoding a PKK protein.

"PKK protein" means the polypeptide expression product of a PKK nucleic acid.

"Portion" means a defined number of contiguous (i.e., linked) nucleobases of a nucleic acid. In certain embodiments, a portion is a defined number of contiguous nucleobases of a target nucleic acid. In certain embodiments, a portion is a defined number of contiguous nucleobases of an antisense compound.

"Prevent" or "preventing" refers to delaying or forestalling the onset or development of a disease, disorder, or condition for a period of time from minutes to days, weeks to months, or indefinitely.

"Prodrug" means a therapeutic agent that is prepared in an inactive form that is converted to an active form (i.e., drug) within the body or cells thereof by the action of endogenous enzymes or other chemicals and/or conditions.

"Prophylactically effective amount" refers to an amount of a pharmaceutical agent that provides a prophylactic or preventative benefit to an animal.

"Region" is defined as a portion of the target nucleic acid having at least one identifiable structure, function, or characteristic.

"Ribonucleotide" means a nucleotide having a hydroxy at the 2' position of the sugar portion of the nucleotide. Ribonucleotides may be modified with any of a variety of substituents.

"Salts" mean a physiologically and pharmaceutically acceptable salts of antisense compounds, i.e., salts that retain the desired biological activity of the parent oligonucleotide and do not impart undesired toxicological effects thereto.

"Segments" are defined as smaller or sub-portions of regions within a target nucleic acid.

"Side effects" means physiological responses attributable to a treatment other than desired effects. In certain embodiments, side effects include, without limitation, injection site reactions, liver function test abnormalities, renal function abnormalities, liver toxicity, renal toxicity, central nervous system abnormalities, and myopathies.

"Single-stranded oligonucleotide" means an oligonucleotide which is not hybridized to a complementary strand.

"Sites," as used herein, are defined as unique nucleobase positions within a target nucleic acid.

"Specifically hybridizable" or "specifically hybridizes" refers to an antisense compound having a sufficient degree of complementarity between an antisense oligonucleotide and a target nucleic acid to induce a desired effect, while exhibiting minimal or no effects on non-target nucleic acids under conditions in which specific binding is desired, i.e., under physiological conditions in the case of in vivo assays and therapeutic treatments.

"Stringent hybridization conditions" or "stringent conditions" refer to conditions under which an oligomeric compound will hybridize to its target sequence, but to a minimal number of other sequences.

"Subject" means a human or non-human animal selected for treatment or therapy.

"Target" refers to a protein, the modulation of which is desired.

"Target gene" refers to a gene encoding a target.

"Targeting" or "targeted" means the process of design and selection of an antisense compound that will specifically hybridize to a target nucleic acid and induce a desired effect.

"Target nucleic acid," "target RNA," and "target RNA transcript" and "nucleic acid target" all mean a nucleic acid capable of being targeted by antisense compounds.

"Target region" means a portion of a target nucleic acid to which one or more antisense compounds is targeted.

"Target segment" means the sequence of nucleotides of a target nucleic acid to which an antisense compound is targeted. "5' target site" refers to the 5'-most nucleotide of a target segment. "3' target site" refers to the 3'-most nucleotide of a target segment.

"Therapeutically effective amount" means an amount of a pharmaceutical agent that provides a therapeutic benefit to an individual.

"Treat" or "treating" or "treatment" refers to administering a composition to effect an improvement of the disease or condition.

"Unmodified nucleobases" mean the purine bases adenine (A) and guanine (G), and the pyrimidine bases thymine (T), cytosine (C) and uracil (U).

"Unmodified nucleotide" means a nucleotide composed of naturally occurring nucleobases, sugar moieties, and internucleoside linkages. In certain embodiments, an unmodified nucleotide is an RNA nucleotide (i.e. β-D-ribonucleosides) or a DNA nucleotide (i.e. β-D-deoxyribonucleoside).

"Upstream" refers to the relative direction toward the 5' end or N-terminal end of a nucleic acid.

"Wing segment" means a plurality of nucleosides modified to impart to an oligonucleotide properties such as enhanced inhibitory activity, increased binding affinity for a target nucleic acid, or resistance to degradation by in vivo nucleases.

Certain Embodiments

Certain embodiments provide compounds, compositions, and methods for inhibiting plasma prekallikrein (PKK) mRNA and protein expression. Certain embodiments provide compounds, compositions, and methods for decreasing PKK mRNA and protein levels.

Certain embodiments provide antisense compounds targeted to a plasma prekallikrein (PKK) nucleic acid. In certain embodiments, the PKK nucleic acid is the sequence set forth in GENBANK Accession No. NM_000892.3 (incorporated herein as SEQ ID NO: 1), GENBANK Accession No. DC412984.1 (incorporated herein as SEQ ID NO: 2), GENBANK Accession No. CN265612.1 (incorporated herein as SEQ ID NO: 3), GENBANK Accession No. AK297672.1 (incorporated herein as SEQ ID NO: 4), GENBANK Accession No. DC413312.1 (incorporated herein as SEQ ID NO: 5), GENBANK Accession No. AV688858.2 (incorporated herein as SEQ ID NO: 6), GENBANK Accession No. CD652077.1 (incorporated herein as SEQ ID NO: 7), GENBANK Accession No. BC143911.1 (incorporated herein as SEQ ID NO: 8), GENBANK Accession No. CB162532.1 (incorporated herein as SEQ ID NO: 9), GENBANK Accession No. NT_016354.19 truncated from nucleobases 111693001 to Ser. No. 11/730,000 (incorporated herein as SEQ ID NO: 10), GENBANK Accession No. NM_008455.2 (incorporated herein as SEQ ID NO: 11), GENBANK Accession No. BB598673.1 (incorporated herein as SEQ ID NO: 12), GENBANK Accession No. NT_039460.7 truncated from nucleobases 6114001 to U.S. Pat. No. 6,144,000 (incorporated herein as SEQ ID NO: 13), GENBANK Accession No. NM_012725.2 (incorporated herein as SEQ ID NO: 14), GENBANK Accession No. NW_047473.1 truncated from nucleobases 10952001 to Ser. No. 10/982,000 (incorporated herein as SEQ ID NO: 15), GENBANK Accession No. XM_002804276.1 (incorporated herein as SEQ ID NO: 17), and GENBANK Accession No.

NW_001118167.1 truncated from nucleobases 2358000 to U.S. Pat. No. 2,391,000 (incorporated herein as SEQ ID NO: 18).

Certain embodiments provide compounds, comprising a modified oligonucleotide consisting of 12 to 30 linked nucleosides and having a nucleobase sequence comprising at least 8, at least 9, at least 10, at least 11, at least 12, at least 13, at least 14, at least 15, at least 16, at least 17, at least 18, at least 19, or at least 20 consecutive nucleobases of any of the nucleobase sequences of SEQ ID NOs: 30-2226.

Certain embodiments provide compounds, comprising a modified oligonucleotide consisting of 12 to 30 linked nucleosides and having a nucleobase sequence comprising at least 8, at least 9, at least 10, at least 11, at least 12, at least 13, at least 14, at least 15, at least 16, at least 17, at least 18, at least 19, or at least 20 consecutive nucleobases of the nucleobase sequence of SEQ ID NO: 570.

Certain embodiments provide compounds, comprising a modified oligonucleotide consisting of 12 to 30 linked nucleosides and having a nucleobase sequence comprising at least 8, at least 9, at least 10, at least 11, at least 12, at least 13, at least 14, at least 15, at least 16, at least 17, at least 18, at least 19, or at least 20 consecutive nucleobases of the nucleobase sequence of SEQ ID NO: 705.

Certain embodiments provide compounds, comprising a modified oligonucleotide consisting of 12 to 30 linked nucleosides and having a nucleobase sequence comprising at least 8, at least 9, at least 10, at least 11, at least 12, at least 13, at least 14, at least 15, or at least 16 consecutive nucleobases of the nucleobase sequence of SEQ ID NO: 1666.

Certain embodiments provide compounds, comprising a modified oligonucleotide consisting of 20 linked nucleosides and having the nucleobase sequence of SEQ ID NO: 570.

Certain embodiments provide compounds, comprising a modified oligonucleotide consisting of 20 linked nucleosides and having the nucleobase sequence of SEQ ID NO: 705.

Certain embodiments provide compounds, comprising a modified oligonucleotide consisting of 16 linked nucleosides and having the nucleobase sequence of SEQ ID NO: 1666.

Certain embodiments provide compounds, comprising a modified oligonucleotide consisting of 12 to 30 linked nucleosides and having a nucleobase sequence comprising at least 8, at least 9, at least 10, at least 11, at least 12, at least 13, at least 14, at least 15, or at least 16 consecutive nucleobases of any of the nucleobase sequences of SEQ ID NOs: 62, 72, 103, 213, 312, 334-339, 344, 345, 346, 348, 349, 351, 369, 373, 381, 382, 383, 385, 387-391, 399, 411, 412, 414, 416, 444, 446-449, 452, 453, 454, 459, 460, 462-472, 473, 476, 477, 479, 480, 481, 484, 489-495, 497, 500, 504, 506, 522, 526, 535, 558, 559, 560, 564, 566, 568-571, 573, 576, 577, 578, 587, 595, 597-604, 607, 608, 610, 613, 615, 618, 619, 622, 623, 624, 633, 635, 636, 638, 639, 640, 642, 643, 645, 652, 655-658, 660, 661, 670, 674-679, 684, 685, 698, 704, 705, 707, 708, 713, 716, 717, 728, 734, 736, 767, 768, 776, 797, 798, 800, 802, 810, 815, 876, 880, 882, 883, 886, 891, 901-905, 908-911, 922, 923, 924, 931, 942, 950-957, 972, 974, 978, 979, 980, 987-991, 1005, 1017-1021, 1025, 1026, 1029, 1030, 1032, 1034, 1035, 1037, 1040, 1041, 1045, 1046, 1051, 1054, 1059, 1060, 1061, 1064, 1065, 1066, 1075, 1076, 1087, 1089, 1111, 1114, 1116, 1117, 1125, 1133, 1153, 1169, 1177, 1181, 1182, 1187, 1196, 1200, 1214, 1222, 1267, 1276, 1277, 1285, 1286, 1289, 1290, 1291, 1303, 1367, 1389, 1393, 1398-1401, 1406, 1407, 1408, 1411, 1419-1422, 1426, 1430, 1431, 1432, 1434-1437, 1439, 1440, 1443, 1444, 1451, 1452, 1471, 1516, 1527, 1535, 1537, 1538, 1539, 1540, 1541, 1563, 1564, 1567, 1568, 1616, 1617, 1623, 1629, 1664, 1665, 1666, 1679, 1687, 1734, 1804, 1876, 1886, 1915, 2008, 2018, 2100, 2101, 2115, and 2116. In certain embodiments, the modified oligonucleotide achieves at least 80% mRNA inhibition of PKK.

Certain embodiments provide compounds, comprising a modified oligonucleotide consisting of 12 to 30 linked nucleosides and having a nucleobase sequence comprising at least 8, at least 9, at least 10, at least 11, at least 12, at least 13, at least 14, at least 15, or at least 16 consecutive nucleobases of any of the nucleobase sequences of SEQ ID NOs: 62, 72, 103, 213, 334-339, 344, 346, 348, 349, 351, 381, 382, 383, 385, 389, 390, 391, 446, 448, 452, 453, 454, 466-473, 476, 481, 484, 491, 492, 494, 495, 497, 504, 526, 558, 559, 566, 568-571, 576, 578, 587, 595, 597, 598, 600-604, 607, 610, 613, 618, 619, 624, 635, 638, 639, 645, 652, 656, 657, 658, 660, 674, 675, 676, 684, 698, 704, 705, 707, 713, 716, 768, 876, 880, 901-905, 908-911, 922, 923, 924, 931, 942, 951, 954-957, 972, 974, 978, 979, 987, 988, 990, 1005, 1019, 1020, 1021, 1025, 1032, 1037, 1040, 1041, 1045, 1054, 1059, 1060, 1061, 1064, 1065, 1066, 1075, 1111, 1116, 1117, 1125, 1133, 1153, 1169, 1177, 1200, 1222, 1267, 1285, 1290, 1291, 1303, 1367, 1398, 1399, 1401, 1406, 1408, 1411, 1419, 1420, 1421, 1426, 1430, 1431, 1432, 1434-1437, 1440, 1443, 1444, 1451, 1537-1540, 1563, 1616, 1679, 1687, 1804, 2008, 2101, 2115, and 2116. In certain embodiments, the modified oligonucleotide achieves at least 85% mRNA inhibition of PKK.

Certain embodiments provide compounds, comprising a modified oligonucleotide consisting of 12 to 30 linked nucleosides and having a nucleobase sequence comprising at least 8, at least 9, at least 10, at least 11, at least 12, at least 13, at least 14, at least 15, or at least 16 consecutive nucleobases of any of the nucleobase sequences of SEQ ID NOs: 334, 346, 351, 382, 390, 391, 446, 448, 452, 453, 468, 469, 470, 471, 472, 476, 481, 491, 495, 504, 558, 566, 568, 570, 571, 578, 587, 597, 598, 600, 604, 613, 635, 638, 645, 656, 658, 660, 674, 675, 684, 704, 705, 880, 901-905, 909, 922, 931, 951, 954, 956, 990, 1005, 1020, 1032, 1037, 1040, 1041, 1045, 1054, 1075, 1111, 1125, 1133, 1153, 1200, 1267, 1291, 1303, 1398, 1399, 1401, 1406, 1420, 1426, 1430, 1431, 1434, 1435, 1436, 1440, 1443, 1451, 1537-1540, 2115, and 2116. In certain embodiments, the modified oligonucleotide achieves at least 90% mRNA inhibition of PKK.

Certain embodiments provide compounds, comprising a modified oligonucleotide consisting of 12 to 30 linked nucleosides and having a nucleobase sequence comprising at least 8, at least 9, at least 10, at least 11, at least 12, at least 13, at least 14, at least 15, or at least 16 consecutive nucleobases of any of the nucleobase sequences of SEQ ID NOs: 334, 391, 448, 468, 469, 568, 570, 598, 635, 658, 674, 684, 705, 901, 903, 904, 922, 990, 1267, 1291, 1420, 1430, 1431, 1434, 1435, 1436, 1537, 1538, and 1540. In certain embodiments, the modified oligonucleotide achieves at least 95% mRNA inhibition of PKK.

Certain embodiments provide compounds, comprising a modified oligonucleotide consisting of 12 to 30 linked nucleosides and having a nucleobase sequence comprising at least 8, at least 9, at least 10, at least 11, at least 12, at least 13, at least 14, at least 15, or at least 16 consecutive nucleobases of any of the nucleobase sequences of SEQ ID NOs: 334, 338, 346, 349, 382, 383, 390, 448, 452, 453, 454, 495, 526, 559, 570, 587, 598, 635, 660, 705, 901, 903, 904, 908, 923, 931, 955, 974, 988, 990, 1020, 1039, 1040, 1111, 1117, 1267, 1291, 1349, 1352, 1367, 1389, 1393, 1399, 1401, 1408, 1411, 1426, 1499, 1516, 1535, 1544, 1548, 1563, 1564, 1568, 1569, 1598, 1616, 1617, 1623, 1624, 1643, 1661, 1665, 1666, 1673, 1679, 1695, 1720, 1804, 1817, 1876, 1881, 1886, 1940, 1947, 2008, 2018, 2019, 2031, 2044, 2100, 2101, 2115, and 2116. In certain embodiments, the modified oligonucleotide achieves an $IC_{50}$ (µM) of 0.4 or less.

Certain embodiments provide compounds, comprising a modified oligonucleotide consisting of 12 to 30 linked nucleosides and having a nucleobase sequence comprising at least 8, at least 9, at least 10, at least 11, at least 12, at least 13, at least 14, at least 15, or at least 16 consecutive nucleobases of any of the nucleobase sequences of SEQ ID NOs: 334, 346, 349, 382, 453, 454, 495, 526, 570, 587, 598, 635, 660, 901, 903, 904, 931, 955, 990, 1020, 1111, 1267, 1349, 1352, 1367, 1389, 1399, 1408, 1411, 1426, 1516, 1535, 1544, 1548, 1563, 1564, 1568, 1569, 1598, 1616, 1617, 1623, 1643, 1661, 1665, 1666, 1673, 1695, 1804, 1876, 1881, 2019, 2044, 2100, 2101, 2115, and 2116. In certain embodiments, the modified oligonucleotide achieves an $IC_{50}$ (µM) of 0.3 or less.

Certain embodiments provide compounds, comprising a modified oligonucleotide consisting of 12 to 30 linked nucleosides and having a nucleobase sequence comprising at least 8, at least 9, at least 10, at least 11, at least 12, at least 13, at least 14, at least 15, or at least 16 consecutive nucleobases of any of the nucleobase sequences of SEQ ID NOs: 334, 346, 382, 453, 495, 526, 570, 587, 598, 635, 901, 904, 931, 955, 1020, 1111, 1349, 1352, 1389, 1426, 1516, 1535, 1544, 1548, 1564, 1569, 1598, 1616, 1617, 1665, 1666, 1804, 1876, 1881, 2019, 2044, 2101, and 2116. In certain embodiments, the modified oligonucleotide achieves an $IC_{50}$ (µM) of 0.2 or less.

Certain embodiments provide compounds, comprising a modified oligonucleotide consisting of 12 to 30 linked nucleosides and having a nucleobase sequence comprising at least 8, at least 9, at least 10, at least 11, at least 12, at least 13, at least 14, at least 15, or at least 16 consecutive nucleobases of any of the nucleobase sequences of SEQ ID NOs: 334, 495, 587, 598, 635, 1349, 1352, 1389, 1516, 1544, 1548, 1569, 1598, 1617, 1665, 1666, 1804, 1881, and 2019. In certain embodiments, the modified oligonucleotide achieves an $IC_{50}$ (µM) of less than 0.2.

Certain embodiments provide compounds, comprising a modified oligonucleotide consisting of 12 to 30 linked nucleosides and comprising a nucleobase sequence comprising at least 8, at least 9, at least 10, at least 11, at least 12, at least 13, at least 14, at least 15, at least 16, at least 17, at least 18, at least 19, or at least 20 consecutive nucleobases complementary to an equal length portion of nucleobases 27427-27466 of SEQ ID NO: 10.

Certain embodiments provide compounds, comprising a modified oligonucleotide consisting of 12 to 30 linked nucleosides and comprising a nucleobase sequence comprising at least 8, at least 9, at least 10, at least 11, at least 12, at least 13, at least 14, at least 15, at least 16, at least 17, at least 18, at least 19, or at least 20 consecutive nucleobases complementary to an equal length portion of nucleobases 33183-33242 of SEQ ID NO: 10.

Certain embodiments provide compounds, comprising a modified oligonucleotide consisting of 12 to 30 linked nucleosides and comprising a nucleobase sequence comprising at least 8, at least 9, at least 10, at least 11, at least 12, at least 13, at least 14, at least 15, at least 16, at least 17, at least 18, at least 19, or at least 20 consecutive nucleobases complementary to an equal length portion of nucleobases 30570-30610 of SEQ ID NO: 10.

Certain embodiments provide compounds, comprising a modified oligonucleotide consisting of 12 to 30 linked nucleosides and comprising a nucleobase sequence comprising at least 8, at least 9, at least 10, at least 11, at least 12, at least 13, at least 14, at least 15, at least 16, at least 17, at least 18, at least 19, or at least 20 consecutive nucleobases complementary to an equal length portion of nucleobases 27427-27520 of SEQ ID NO: 10.

Certain embodiments provide compounds, comprising a modified oligonucleotide consisting of 12 to 30 linked nucleosides and comprising a nucleobase sequence comprising at least 8, at least 9, at least 10, at least 11, at least 12, at least 13, at least 14, at least 15, at least 16, at least 17, at least 18, at least 19, or at least 20 consecutive nucleobases complementary to an equal length portion of nucleobases 33085-33247 of SEQ ID NO: 10.

Certain embodiments provide compounds, comprising a modified oligonucleotide consisting of 12 to 30 linked nucleosides and comprising a nucleobase sequence comprising at least 8, at least 9, at least 10, at least 11, at least 12, at least 13, at least 14, at least 15, at least 16, at least 17, at least 18, at least 19, or at least 20 consecutive nucleobases complementary to an equal length portion of nucleobases 30475-30639 of SEQ ID NO: 10.

Certain embodiments provide compounds, comprising a modified oligonucleotide consisting of 12 to 30 linked nucleosides and comprising a nucleobase sequence comprising at least 8, at least 9, at least 10, at least 11, at least 12, at least 13, at least 14, at least 15, at least 16, at least 17, at least 18, at least 19, or at least 20 consecutive nucleobases complementary to an equal length portion of nucleobases 27362-27524 of SEQ ID NO: 10.

Certain embodiments provide compounds, comprising a modified oligonucleotide consisting of 12 to 30 linked nucleosides and comprising a nucleobase sequence comprising at least 8, at least 9, at least 10, at least 11, at least 12, at least 13, at least 14, at least 15, at least 16, at least 17, at least 18, at least 19, or at least 20 consecutive nucleobases complementary to an equal length portion of nucleobases 33101-33240 of SEQ ID NO: 10.

Certain embodiments provide compounds, comprising a modified oligonucleotide consisting of 12 to 30 linked nucleosides and comprising a nucleobase sequence comprising at least 8, at least 9, at least 10, at least 11, at least 12, at least 13, at least 14, at least 15, at least 16, at least 17, at least 18, at least 19, or at least 20 consecutive nucleobases complementary to an equal length portion of nucleobases 30463-30638 of SEQ ID NO: 10.

Certain embodiments provide compounds, comprising a modified oligonucleotide consisting of 12 to 30 linked nucleosides and comprising a nucleobase sequence comprising at least 8, at least 9, at least 10, at least 11, at least 12, at least 13, at least 14, at least 15, at least 16, at least 17, at least 18, at least 19, or at least 20 consecutive nucleobases complementary to an equal length portion of exon 9, exon 12, or exon 14 of a PKK nucleic acid.

In certain embodiments the nucleobase sequence of the modified oligonucleotide is at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% complementary to SEQ ID NO: 10.

In certain embodiments, the compound consists of a single-stranded modified oligonucleotide.

In certain embodiments, at least one internucleoside linkage of the modified oligonucleotide is a modified internucleoside linkage.

In certain embodiments, at least one modified internucleoside linkage of the modified oligonucleotide is a phosphorothioate internucleoside linkage.

In certain embodiments, each internucleoside linkage of the modified oligonucleotide is a phosphorothioate linkage.

In certain embodiments, at least one nucleoside of the modified oligonucleotide comprises a modified nucleobase.

In certain embodiments, the modified nucleobase is a 5-methylcytosine.

In certain embodiments, the modified oligonucleotide comprises at least one modified sugar.

In certain embodiments, the modified sugar is a 2' modified sugar, a BNA, or a THP.

In certain embodiments, the modified sugar is any of a 2'-O-methoxyethyl, 2'-O-methyl, a constrained ethyl, a LNA, or a 3'-fluoro-HNA.

In certain embodiments, the compound comprises at least one 2'-O-methoxyethyl nucleoside, 2'-O-methyl nucleoside, constrained ethyl nucleoside, LNA nucleoside, or 3'-fluoro-HNA nucleoside.

In certain embodiments, the modified oligonucleotide comprises:
 a gap segment consisting of 10 linked deoxynucleosides;
 a 5' wing segment consisting of 5 linked nucleosides; and
 a 3' wing segment consisting of 5 linked nucleosides;
 wherein the gap segment is positioned between the 5' wing segment and the 3' wing segment and wherein each nucleoside of each wing segment comprises a modified sugar.

In certain embodiments, the modified oligonucleotide consists of 20 linked nucleosides.

In certain embodiments, the modified oligonucleotide consists of 19 linked nucleosides.

In certain embodiments, the modified oligonucleotide consists of 18 linked nucleosides.

Certain embodiments provide compounds consisting of a modified oligonucleotide according to the following formula: Tes Ges mCes Aes Aes Gds Tds mCds Tds mCds Tds Tds Gds Gds mCds Aes Aes Aes mCes Ae; wherein,
 A=an adenine,
 mC=a 5'-methylcytosine
 G=a guanine,
 T=a thymine,
 e=a 2'-O-methoxyethyl modified nucleoside,
 d=a 2'-deoxynucleoside, and
 s=a phosphorothioate internucleoside linkage.

Certain embodiments provide compounds consisting of a modified oligonucleotide according to the following formula: mCes mCes mCes mCes mCes Tds Tds mCds Tds Tds Tds Ads Tds Ads Gds mCes mCes Aes Ges mCe; wherein,
 A=an adenine,
 mC=a 5'-methylcytosine;
 G=a guanine,
 T=a thymine,
 e=a 2'-O-methoxyethyl modified nucleoside,
 d=a 2'-deoxynucleoside, and
 s=a phosphorothioate internucleoside linkage.

Certain embodiments provide compounds consisting of a modified oligonucleotide according to the following formula: mCes Ges Aks Tds Ads Tds mCds Ads Tds Gds Ads Tds Tds mCks mCks mCe; wherein,
 A=an adenine,
 mC=a 5'-methylcytosine;
 G=a guanine,
 T=a thymine,
 e=a 2'-O-methoxyethyl modified nucleoside,
 k=a cEt modified nucleoside,
 d=a 2'-deoxynucleoside, and
 s=a phosphorothioate internucleoside linkage.

Certain embodiments provide compounds according to the following formula:

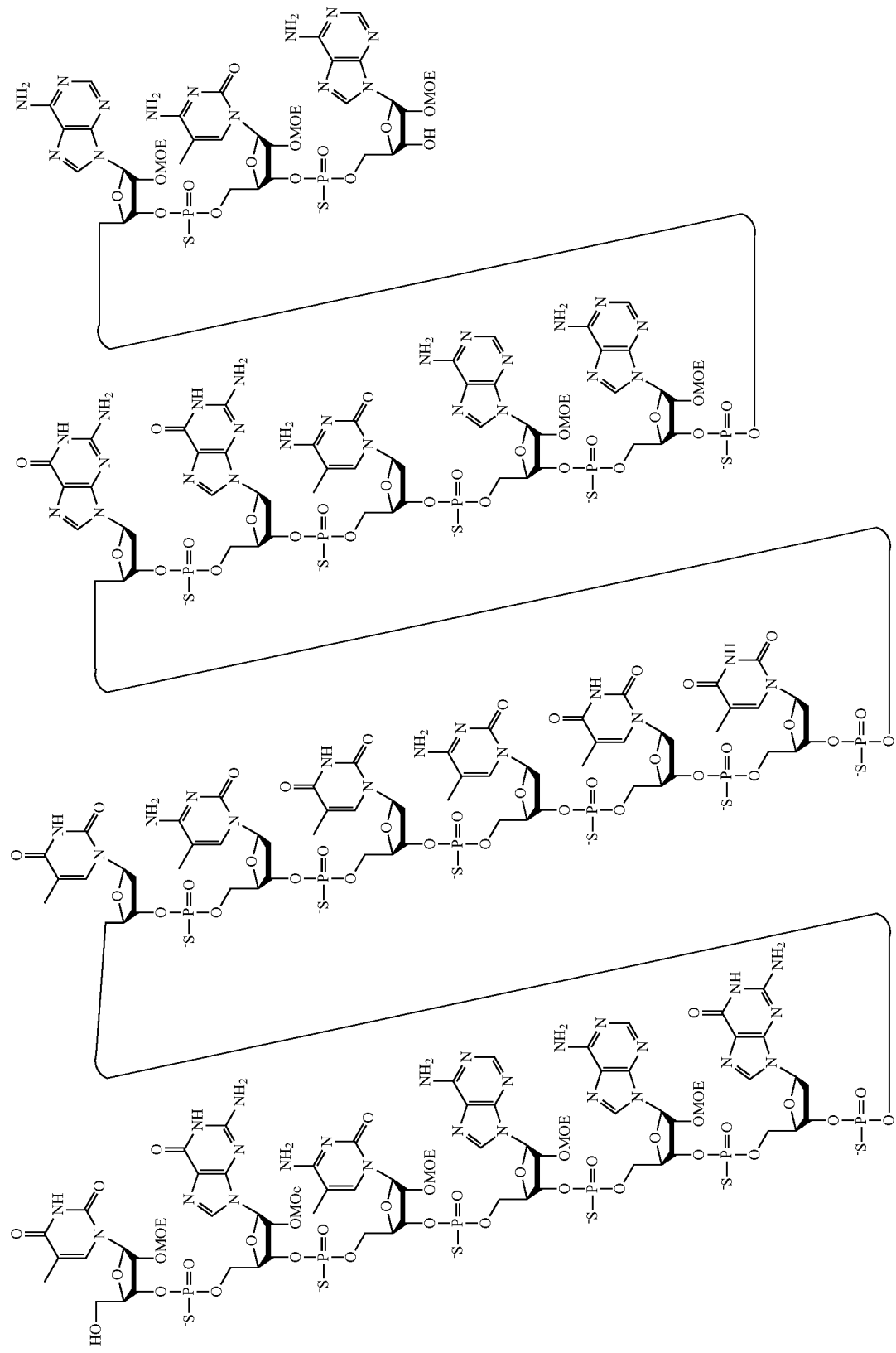

Certain embodiments provide compounds according to the following formula:

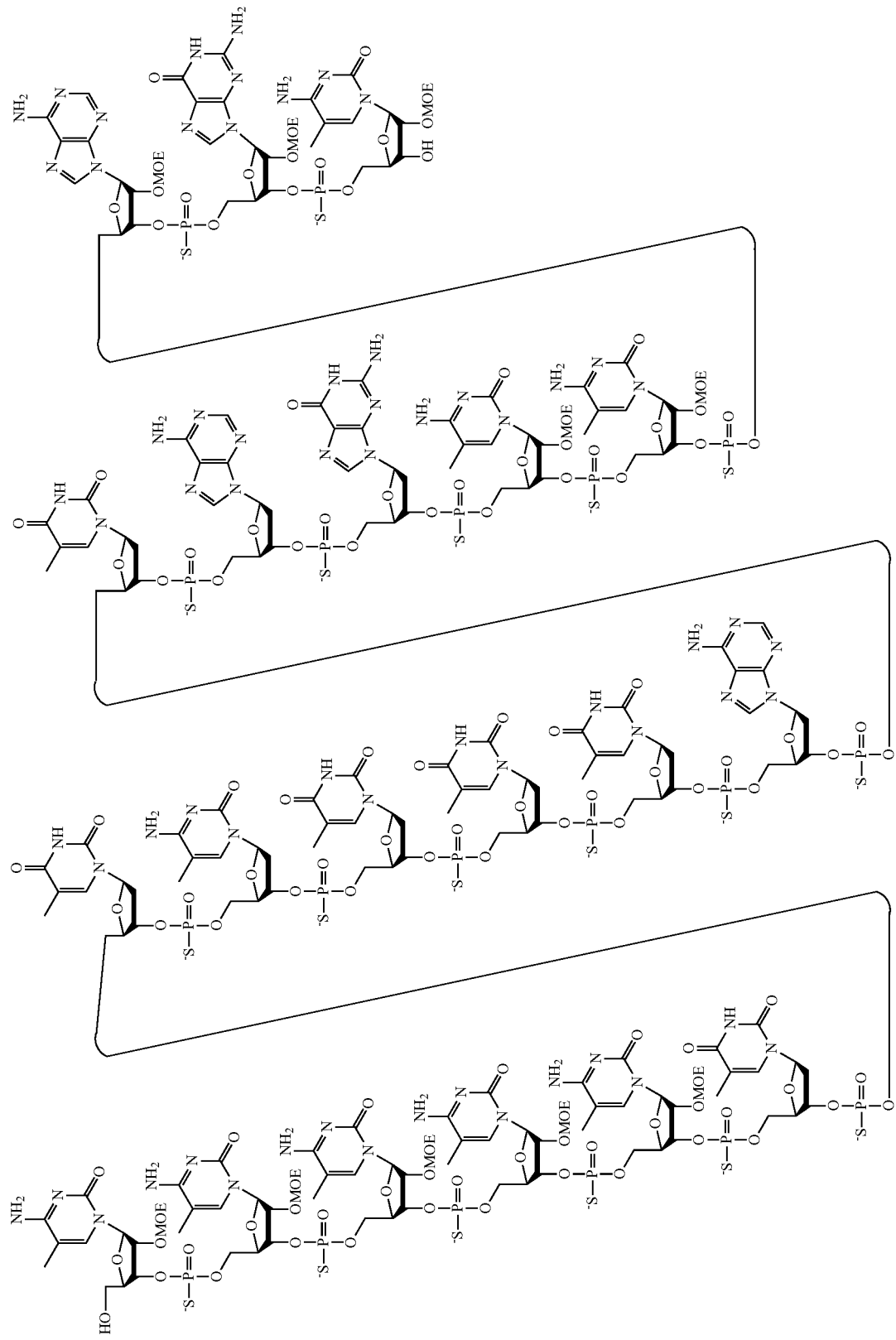

Certain embodiments provide compounds according to the following formula:

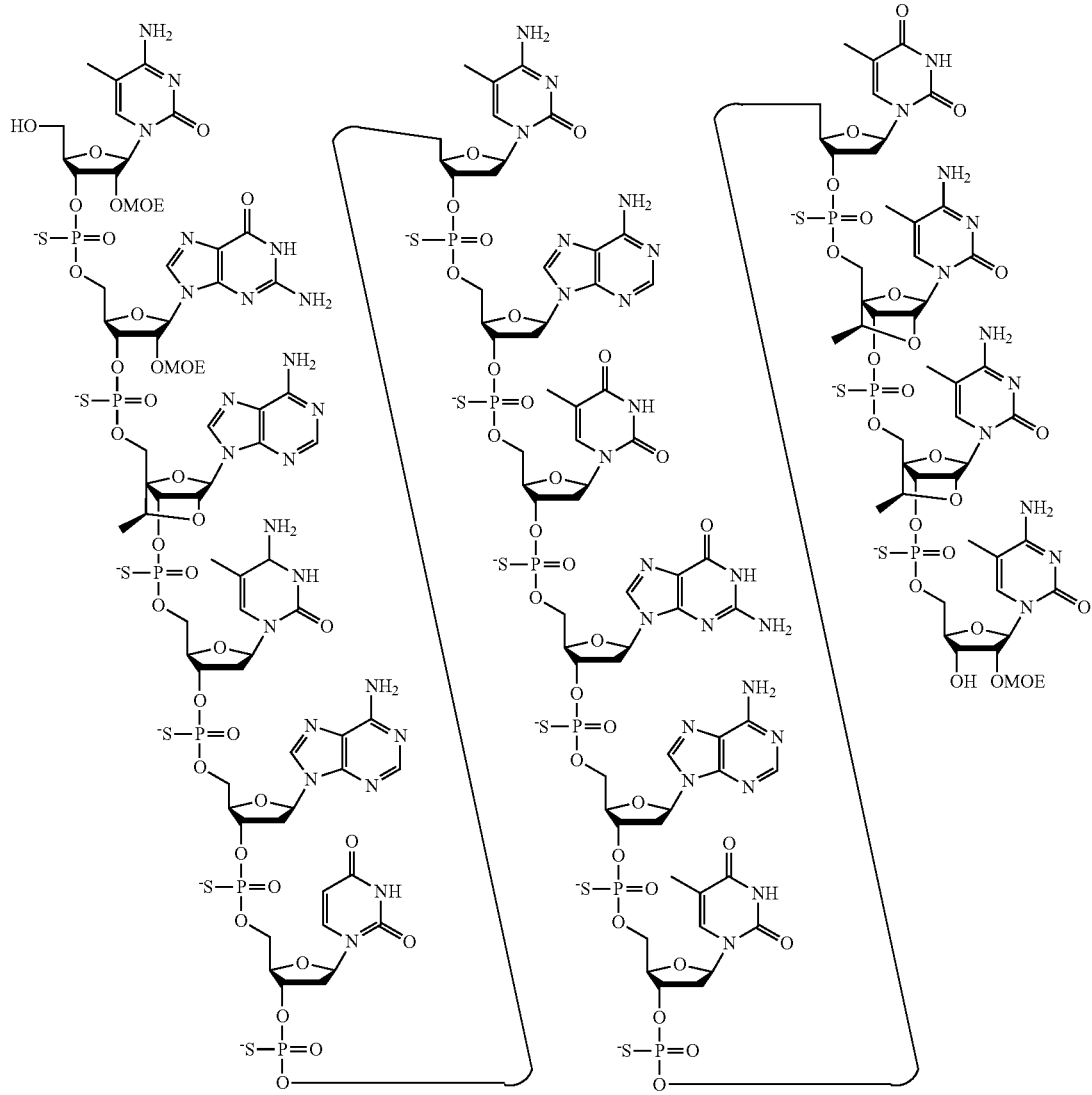

Certain embodiments provide compositions comprising the compound of any preceding claim or salt thereof and at least one of a pharmaceutically acceptable carrier or diluent.

Certain embodiments provide methods comprising administering to an animal the compound or composition of any preceding claim.

In certain embodiments, the animal is a human.

In certain embodiments, administering the compound prevents, treats, or ameliorates a PKK associated disease, disorder or condition.

In certain embodiments, the PKK associated disease, disorder or condition is a hereditary angioedema (HAE), edema, angioedema, swelling, angioedema of the lids, ocular edema, macular edema, cerebral edema, thrombosis, embolism, thromboembolism, deep vein thrombosis, pulmonary embolism, myocardial infarction, stroke, or infarct.

Certain embodiments provide use of the compound or composition of any preceding claim for the manufacture of a medicament for treating an inflammatory disease or a thromboembolic disease.

Antisense Compounds

Oligomeric compounds include, but are not limited to, oligonucleotides, oligonucleosides, oligonucleotide analogs, oligonucleotide mimetics, antisense compounds, antisense oligonucleotides, and siRNAs. An oligomeric compound may be "antisense" to a target nucleic acid, meaning that is capable of undergoing hybridization to a target nucleic acid through hydrogen bonding.

In certain embodiments, an antisense compound has a nucleobase sequence that, when written in the 5' to 3' direction, comprises the reverse complement of the target segment of a target nucleic acid to which it is targeted. In certain such embodiments, an antisense oligonucleotide has a nucleobase sequence that, when written in the 5' to 3' direction, comprises the reverse complement of the target segment of a target nucleic acid to which it is targeted.

In certain embodiments, an antisense compound targeted to a PKK nucleic acid is 12 to 30 subunits in length. In certain embodiments, an antisense compound targeted to PKK nucleic acid is 12 to 25 subunits in length. In certain embodiments, an antisense compound targeted to PKK nucleic acid is 12 to 22 subunits in length. In certain embodiments, an antisense compound targeted to PKK nucleic acid is 14 to 20 subunits in length. In certain embodiments, an antisense compound targeted to PKK nucleic acid is 15 to 25 subunits in length. In certain embodiments, an antisense compound targeted to PKK nucleic acid is 18 to 22 subunits in length. In certain embodiments, an antisense compound targeted to PKK nucleic acid is 19 to 21 subunits in length. In certain embodiments, the antisense compound is 8 to 80, 12 to 50, 13 to 30, 13 to 50, 14 to 30, 14 to 50, 15 to 30, 15 to 50, 16 to 30, 16 to 50, 17 to 30, 17 to 50, 18 to 30, 18 to 50, 19 to 30, 19 to 50, or 20 to 30 linked subunits in length.

In certain embodiments, an antisense compound targeted to a PKK nucleic acid is 12 subunits in length. In certain embodiments, an antisense compound targeted to a PKK nucleic acid is 13 subunits in length. In certain embodiments, an antisense compound targeted to a PKK nucleic acid is 14 subunits in length. In certain embodiments, an antisense compound targeted to a PKK nucleic acid is 15 subunits in length. In certain embodiments, an antisense compound targeted to a PKK nucleic acid is 16 subunits in length. In certain embodiments, an antisense compound targeted to a PKK nucleic acid is 17 subunits in length. In certain embodiments, an antisense compound targeted to a PKK nucleic acid is 18 subunits in length. In certain embodiments, an antisense compound targeted to a PKK nucleic acid is 19 subunits in length. In certain embodiments, an antisense compound targeted to a PKK nucleic acid is 20 subunits in length. In certain embodiments, an antisense compound targeted to a PKK nucleic acid is 21 subunits in length. In certain embodiments, an antisense compound targeted to a PKK nucleic acid is 22 subunits in length. In certain embodiments, an antisense compound targeted to a PKK nucleic acid is 23 subunits in length. In certain embodiments, an antisense compound targeted to a PKK nucleic acid is 24 subunits in length. In certain embodiments, an antisense compound targeted to a PKK nucleic acid is 25 subunits in length. In certain embodiments, an antisense compound targeted to a PKK nucleic acid is 26 subunits in length. In certain embodiments, an antisense compound targeted to a PKK nucleic acid is 27 subunits in length. In certain embodiments, an antisense compound targeted to a PKK nucleic acid is 28 subunits in length. In certain embodiments, an antisense compound targeted to a PKK nucleic acid is 29 subunits in length. In certain embodiments, an antisense compound targeted to a PKK nucleic acid is 30 subunits in length. In certain embodiments, the antisense compound targeted to a PKK nucleic acid is 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, or 80 linked subunits in length, or a range defined by any two of the above values. In certain embodiments the antisense compound is an antisense oligonucleotide, and the linked subunits are nucleosides.

In certain embodiments antisense oligonucleotides targeted to a PKK nucleic acid may be shortened or truncated. For example, a single subunit may be deleted from the 5' end (5' truncation), or alternatively from the 3' end (3' truncation). A shortened or truncated antisense compound targeted to a PKK nucleic acid may have two subunits deleted from the 5' end, or alternatively may have two subunits deleted from the 3' end, of the antisense compound. Alternatively, the deleted nucleosides may be dispersed throughout the antisense compound, for example, in an antisense compound having one nucleoside deleted from the 5' end and one nucleoside deleted from the 3' end.

When a single additional subunit is present in a lengthened antisense compound, the additional subunit may be located at the 5' or 3' end of the antisense compound. When two or more additional subunits are present, the added subunits may be adjacent to each other, for example, in an antisense compound having two subunits added to the 5' end (5' addition), or alternatively to the 3' end (3' addition), of the antisense compound. Alternatively, the added subunits may be dispersed throughout the antisense compound, for example, in an antisense compound having one subunit added to the 5' end and one subunit added to the 3' end.

It is possible to increase or decrease the length of an antisense compound, such as an antisense oligonucleotide, and/or introduce mismatch bases without eliminating activity. For example, in Woolf et al. (Proc. Natl. Acad. Sci. USA 89:7305-7309, 1992), a series of antisense oligonucleotides 13-25 nucleobases in length were tested for their ability to induce cleavage of a target RNA in an oocyte injection model. Antisense oligonucleotides 25 nucleobases in length with 8 or 11 mismatch bases near the ends of the antisense oligonucleotides were able to direct specific cleavage of the target mRNA, albeit to a lesser extent than the antisense oligonucleotides that contained no mismatches. Similarly, target specific cleavage was achieved using 13 nucleobase antisense oligonucleotides, including those with 1 or 3 mismatches.

Gautschi et al (J. Natl. Cancer Inst. 93:463-471, March 2001) demonstrated the ability of an oligonucleotide having 100% complementarity to the bcl-2 mRNA and having 3 mismatches to the bcl-xL mRNA to reduce the expression of both bcl-2 and bcl-xL in vitro and in vivo. Furthermore, this oligonucleotide demonstrated potent anti-tumor activity in vivo.

Maher and Dolnick (Nuc. Acid. Res. 16:3341-3358, 1988) tested a series of tandem 14 nucleobase antisense oligonucleotides, and a 28 and 42 nucleobase antisense oligonucleotides comprised of the sequence of two or three of the tandem antisense oligonucleotides, respectively, for their ability to arrest translation of human DHFR in a rabbit reticulocyte assay. Each of the three 14 nucleobase antisense oligonucleotides alone was able to inhibit translation, albeit at a more modest level than the 28 or 42 nucleobase antisense oligonucleotides.

Antisense Compound Motifs

In certain embodiments, antisense compounds targeted to a PKK nucleic acid have chemically modified subunits arranged in patterns, or motifs, to confer to the antisense compounds properties such as enhanced inhibitory activity, increased binding affinity for a target nucleic acid, or resistance to degradation by in vivo nucleases.

Chimeric antisense compounds typically contain at least one region modified so as to confer increased resistance to nuclease degradation, increased cellular uptake, increased binding affinity for the target nucleic acid, and/or increased inhibitory activity. A second region of a chimeric antisense compound may optionally serve as a substrate for the cellular endonuclease RNase H, which cleaves the RNA strand of an RNA:DNA duplex.

Antisense compounds having a gapmer motif are considered chimeric antisense compounds. In a gapmer an internal region having a plurality of nucleotides that supports RNaseH cleavage is positioned between external regions having a plurality of nucleotides that are chemically distinct from the nucleosides of the internal region. In the case of an antisense oligonucleotide having a gapmer motif, the gap segment generally serves as the substrate for endonuclease cleavage, while the wing segments comprise modified nucleosides. In certain embodiments, the regions of a gapmer are differentiated by the types of sugar moieties comprising each distinct region. The types of sugar moieties that are used to differentiate the regions of a gapmer may in some embodiments include β-D-ribonucleosides, β-D-deoxyribonucleosides, 2'-modified nucleosides (such 2'-modified nucleosides may include 2'-MOE, and 2'-O—$CH_3$, among others), and bicyclic sugar modified nucleosides (such bicyclic sugar modified nucleosides may include those having a 4'-$(CH_2)_n$-O-2' bridge, where n=1 or n=2 and 4'-$CH_2$—O—$CH_2$-2'). In certain embodiments, wings may include several modified sugar moieties, including, for example 2'-MOE. In certain embodiments, wings may include several modified and unmodified sugar moieties. In certain embodiments, wings may include various combinations of 2'-MOE nucleosides and 2'-deoxynucleosides.

Each distinct region may comprise uniform sugar moieties, variant, or alternating sugar moieties. The wing-gap-wing motif is frequently described as "X-Y-Z", where "X" represents the length of the 5' wing, "Y" represents the length of the gap, and "Z" represents the length of the 3' wing. "X" and "Z" may comprise uniform, variant, or alternating sugar moieties. In certain embodiments, "X" and "Y" may include one or more 2'-deoxynucleosides. "Y" may comprise 2'-deoxynucleosides. As used herein, a gapmer described as "X-Y-Z" has a configuration such that the gap is positioned immediately adjacent to each of the 5' wing and the 3' wing. Thus, no intervening nucleotides exist between the 5' wing and gap, or the gap and the 3' wing. Any of the antisense compounds described herein can have a gapmer motif. In certain embodiments, "X" and "Z" are the same; in other embodiments they are different.

In certain embodiments, gapmers provided herein include, for example 20-mers having a motif of 5-10-5.

Target Nucleic Acids, Target Regions and Nucleotide Sequences

Nucleotide sequences that encode human plasma prekallikrein (PKK) include, without limitation, the following: GENBANK Accession No. NM_000892.3 (incorporated herein as SEQ ID NO: 1), GENBANK Accession No. DC412984.1 (incorporated herein as SEQ ID NO: 2), GENBANK Accession No. CN265612.1 (incorporated herein as SEQ ID NO: 3), GENBANK Accession No. AK297672.1 (incorporated herein as SEQ ID NO: 4), GENBANK Accession No. DC413312.1 (incorporated herein as SEQ ID NO: 5), GENBANK Accession No. AV688858.2 (incorporated herein as SEQ ID NO: 6), GENBANK Accession No. CD652077.1 (incorporated herein as SEQ ID NO: 7), GENBANK Accession No. BC143911.1 (incorporated herein as SEQ ID NO: 8), GENBANK Accession No. CB162532.1 (incorporated herein as SEQ ID NO: 9), GENBANK Accession No. NT_016354.19 truncated from nucleobases 111693001 to Ser. No. 11/730,000 (incorporated herein as SEQ ID NO: 10), GENBANK Accession No. NM_008455.2 (incorporated herein as SEQ ID NO: 11), GENBANK Accession No. BB598673.1 (incorporated herein as SEQ ID NO: 12), GENBANK Accession No. NT_039460.7 truncated from nucleobases 6114001 to U.S. Pat. No. 6,144,000 (incorporated herein as SEQ ID NO: 13), GENBANK Accession No. NM_012725.2 (incorporated herein as SEQ ID NO: 14), GENBANK Accession No. NW_047473.1 truncated from nucleobases 10952001 to Ser. No. 10/982,000 (incorporated herein as SEQ ID NO: 15), GENBANK Accession No. XM_002804276.1 (incorporated herein as SEQ ID NO: 17), and GENBANK Accession No. NW_001118167.1 truncated from nucleobases 2358000 to U.S. Pat. No. 2,391,000 (incorporated herein as SEQ ID NO: 18).

It is understood that the sequence set forth in each SEQ ID NO in the Examples contained herein is independent of any modification to a sugar moiety, an internucleoside linkage, or a nucleobase. As such, antisense compounds defined by a SEQ ID NO may comprise, independently, one or more modifications to a sugar moiety, an internucleoside linkage, or a nucleobase. Antisense compounds described by Isis Number (Isis No) indicate a combination of nucleobase sequence and motif.

In certain embodiments, a target region is a structurally defined region of the target nucleic acid. For example, a target region may encompass a 3' UTR, a 5' UTR, an exon, an intron, an exon/intron junction, a coding region, a translation initiation region, translation termination region, or other defined nucleic acid region. The structurally defined regions for PKK can be obtained by accession number from sequence databases such as NCBI and such information is incorporated herein by reference. In certain embodiments, a target region may encompass the sequence from a 5' target site of one target segment within the target region to a 3' target site of another target segment within the same target region.

Targeting includes determination of at least one target segment to which an antisense compound hybridizes, such that a desired effect occurs. In certain embodiments, the desired effect is a reduction in mRNA target nucleic acid levels. In certain embodiments, the desired effect is reduction of levels of protein encoded by the target nucleic acid or a phenotypic change associated with the target nucleic acid.

A target region may contain one or more target segments. Multiple target segments within a target region may be overlapping. Alternatively, they may be non-overlapping. In certain embodiments, target segments within a target region are separated by no more than about 300 nucleotides. In certain embodiments, target segments within a target region are separated by a number of nucleotides that is, is about, is no more than, is no more than about, 250, 200, 150, 100, 90, 80, 70, 60, 50, 40, 30, 20, or 10 nucleotides on the target nucleic acid, or is a range defined by any two of the preceeding values. In certain embodiments, target segments within a target region are separated by no more than, or no more than about, 5 nucleotides on the target nucleic acid. In certain embodiments, target segments are contiguous. Contemplated are target regions defined by a range having a starting nucleic acid that is any of the 5' target sites or 3' target sites listed herein.

Suitable target segments may be found within a 5' UTR, a coding region, a 3' UTR, an intron, an exon, or an exon/intron junction. Target segments containing a start codon or a stop codon are also suitable target segments. A suitable target segment may specifically exclude a certain structurally defined region such as the start codon or stop codon.

The determination of suitable target segments may include a comparison of the sequence of a target nucleic acid to other sequences throughout the genome. For example, the BLAST algorithm may be used to identify regions of similarity amongst different nucleic acids. This comparison can prevent the selection of antisense compound sequences that may hybridize in a non-specific manner to sequences other than a selected target nucleic acid (i.e., non-target or off-target sequences).

There may be variation in activity (e.g., as defined by percent reduction of target nucleic acid levels) of the antisense compounds within an active target region. In certain embodiments, reductions in PKK mRNA levels are indicative of inhibition of PKK expression. Reductions in levels of a PKK protein are also indicative of inhibition of target mRNA expression. Further, phenotypic changes are indicative of inhibition of PKK expression. For example, reduced or prevented inflammation can be indicative of inhibition of PKK expression. In another example, reduced or prevented edema/swelling can be indicative of inhibition of PKK expression. In another example, reduced or prevented vascular permeability can be indicative of inhibition of PKK expression. In another example, reduced or prevented vascular leakage can be indicative of inhibition of PKK expression. In certain embodiments, vascular permeability is measured by quantification of a dye, such as Evans Blue.

Hybridization

In some embodiments, hybridization occurs between an antisense compound disclosed herein and a target nucleic acid. The most common mechanism of hybridization involves hydrogen bonding (e.g., Watson-Crick, Hoogsteen or reversed Hoogsteen hydrogen bonding) between complementary nucleobases of the nucleic acid molecules.

Hybridization can occur under varying conditions. Stringent conditions are sequence-dependent and are determined by the nature and composition of the nucleic acid molecules to be hybridized.

Methods of determining whether a sequence is specifically hybridizable to a target nucleic acid are well known in the art. In certain embodiments, the antisense compounds provided herein are specifically hybridizable with a target nucleic acid.

Complementarity

An antisense compound and a target nucleic acid are complementary to each other when a sufficient number of nucleobases of the antisense compound can hydrogen bond with the corresponding nucleobases of the target nucleic acid, such that a desired effect will occur (e.g., antisense inhibition of a target nucleic acid, such as a PKK nucleic acid).

Non-complementary nucleobases between an antisense compound and a PKK nucleic acid may be tolerated provided that the antisense compound remains able to specifically hybridize to a target nucleic acid. Moreover, an antisense compound may hybridize over one or more segments of a PKK nucleic acid such that intervening or adjacent segments are not involved in the hybridization event (e.g., a loop structure, mismatch or hairpin structure).

In certain embodiments, the antisense compounds provided herein, or a specified portion thereof, are, or are at least, 70%, 80%, 81%, 82%, 83%, 84%, 85%, 86%, 87%, 88%, 89%, 90%, 91%, 92%, 93%, 94%, 95%, 96%, 97%, 98%, 99%, or 100% complementary to an PKK nucleic acid, a target region, target segment, or specified portion thereof. Percent complementarity of an antisense compound with a target nucleic acid can be determined using routine methods.

For example, an antisense compound in which 18 of 20 nucleobases of the antisense compound are complementary to a target region, and would therefore specifically hybridize, would represent 90 percent complementarity. In this example, the remaining noncomplementary nucleobases may be clustered or interspersed with complementary nucleobases and need not be contiguous to each other or to complementary nucleobases. As such, an antisense compound which is 18 nucleobases in length having four non-complementary nucleobases which are flanked by two regions of complete complementarity with the target nucleic acid would have 77.8% overall complementarity with the target nucleic acid and would thus fall within the scope of the present invention. Percent complementarity of an antisense compound with a region of a target nucleic acid can be determined routinely using BLAST programs (basic local alignment search tools) and PowerBLAST programs known in the art (Altschul et al., *J. Mol. Biol.*, 1990, 215, 403 410; Zhang and Madden, Genome Res., 1997, 7, 649 656). Percent homology, sequence identity or complementarity, can be determined by, for example, the Gap program (Wisconsin Sequence Analysis Package, Version 8 for Unix, Genetics Computer Group, University Research Park, Madison Wis.), using default settings, which uses the algorithm of Smith and Waterman (Adv. Appl. Math., 1981, 2, 482 489).

In certain embodiments, the antisense compounds provided herein, or specified portions thereof, are fully complementary (i.e. 100% complementary) to a target nucleic acid, or specified portion thereof. For example, an antisense compound may be fully complementary to a plasma prekallikrein nucleic acid, or a target region, or a target segment or target sequence thereof. As used herein, "fully complementary" means each nucleobase of an antisense compound is capable of precise base pairing with the corresponding nucleobases of a target nucleic acid. For example, a 20 nucleobase antisense compound is fully complementary to a target sequence that is 400 nucleobases long, so long as there is a corresponding 20 nucleobase portion of the target nucleic acid that is fully complementary to the antisense compound. Fully complementary can also be used in reference to a specified portion of the first and/or the second nucleic acid. For example, a 20 nucleobase portion of a 30 nucleobase antisense compound can be "fully complementary" to a target sequence that is 400 nucleobases long. The 20 nucleobase portion of the 30 nucleobase oligonucleotide is fully complementary to the target sequence if the target sequence has a corresponding 20 nucleobase portion wherein each nucleobase is complementary to the 20 nucleobase portion of the antisense compound. At the same time, the entire 30 nucleobase antisense compound may or may not be fully complementary to the target sequence, depending on whether the remaining 10 nucleobases of the antisense compound are also complementary to the target sequence.

The location of a non-complementary nucleobase may be at the 5' end or 3' end of the antisense compound. Alternatively, the non-complementary nucleobase or nucleobases may be at an internal position of the antisense compound. When two or more non-complementary nucleobases are present, they may be contiguous (i.e. linked) or non-contiguous. In one embodiment, a non-complementary nucleobase is located in the wing segment of a gapmer antisense oligonucleotide.

In certain embodiments, antisense compounds that are, or are up to 11, 12, 13, 14, 15, 16, 17, 18, 19, or 20 nucleobases in length comprise no more than 4, no more than 3, no more than 2, or no more than 1 non-complementary nucleobase(s) relative to a target nucleic acid or specified portion thereof.

In certain embodiments, antisense compounds that are, or are up to 11, 12, 13, 14, 15, 16, 17, 18, 19, 20, 21, 22, 23, 24, 25, 26, 27, 28, 29, or 30 nucleobases in length comprise no more than 6, no more than 5, no more than 4, no more than 3, no more than 2, or no more than 1 non-complementary nucleobase(s) relative to a target nucleic acid or specified portion thereof.

The antisense compounds provided also include those which are complementary to a portion of a target nucleic acid. As used herein, "portion" refers to a defined number of contiguous (i.e. linked) nucleobases within a region or segment of a target nucleic acid. A "portion" can also refer to a defined number of contiguous nucleobases of an antisense compound. In certain embodiments, the antisense compounds, are complementary to at least an 8 nucleobase portion of a target segment. In certain embodiments, the antisense compounds are complementary to at least a 9 nucleobase portion of a target segment. In certain embodiments, the antisense compounds are complementary to at least a 10 nucleobase portion of a target segment. In certain embodiments, the antisense compounds are complementary to at least an 11 nucleobase portion of a target segment. In certain embodiments, the antisense compounds are complementary to at least a 12 nucleobase portion of a target segment. In certain embodiments, the antisense compounds are complementary to at least a 13 nucleobase portion of a target segment. In certain embodiments, the antisense compounds are complementary to at least a 14 nucleobase portion of a target segment. In certain embodiments, the antisense compounds are complementary to at least a 15 nucleobase portion of a target segment. Also contemplated are antisense compounds that are complementary to at least a 9, 10, 11, 12, 13, 14, 15, 16, 17, 18, 19, 20, or more nucleobase portion of a target segment, or a range defined by any two of these values.

Identity

The antisense compounds provided herein may also have a defined percent identity to a particular nucleotide sequence, SEQ ID NO, or compound represented by a specific Isis number, or portion thereof. As used herein, an antisense compound is identical to the sequence disclosed herein if it has the same nucleobase pairing ability. For example, a RNA which contains uracil in place of thymidine in a disclosed DNA sequence would be considered identical to the DNA sequence since both uracil and thymidine pair with adenine. Shortened and lengthened versions of the antisense compounds described herein as well as compounds having non-identical bases relative to the antisense compounds provided herein also are contemplated. The non-identical bases may be adjacent to each other or dispersed throughout the antisense compound. Percent identity of an antisense compound is calculated according to the number of bases that have identical base pairing relative to the sequence to which it is being compared.

In certain embodiments, the antisense compounds, or portions thereof, are at least 70%, 75%, 80%, 85%, 90%, 95%, 96%, 97%, 98%, 99% or 100% identical to one or more of the antisense compounds or SEQ ID NOs, or a portion thereof, disclosed herein.

In certain embodiments, a portion of the antisense compound is compared to an equal length portion of the target nucleic acid. In certain embodiments, an 8, 9, 10, 11, 12, 13, 14, 15, 16, 17, 18, 19, 20, 21, 22, 23, 24, or 25 nucleobase portion is compared to an equal length portion of the target nucleic acid.

In certain embodiments, a portion of the antisense oligonucleotide is compared to an equal length portion of the target nucleic acid. In certain embodiments, an 8, 9, 10, 11, 12, 13, 14, 15, 16, 17, 18, 19, 20, 21, 22, 23, 24, or 25 nucleobase portion is compared to an equal length portion of the target nucleic acid.

Modifications

A nucleoside is a base-sugar combination. The nucleobase (also known as base) portion of the nucleoside is normally a heterocyclic base moiety. Nucleotides are nucleosides that further include a phosphate group covalently linked to the sugar portion of the nucleoside. For those nucleosides that include a pentofuranosyl sugar, the phosphate group can be linked to the 2', 3' or 5' hydroxyl moiety of the sugar. Oligonucleotides are formed through the covalent linkage of adjacent nucleosides to one another, to form a linear polymeric oligonucleotide. Within the oligonucleotide structure, the phosphate groups are commonly referred to as forming the internucleoside linkages of the oligonucleotide.

Modifications to antisense compounds encompass substitutions or changes to internucleoside linkages, sugar moieties, or nucleobases. Modified antisense compounds are often preferred over native forms because of desirable properties such as, for example, enhanced cellular uptake, enhanced affinity for nucleic acid target, increased stability in the presence of nucleases, or increased inhibitory activity.

Chemically modified nucleosides may also be employed to increase the binding affinity of a shortened or truncated antisense oligonucleotide for its target nucleic acid. Consequently, comparable results can often be obtained with shorter antisense compounds that have such chemically modified nucleosides.

Modified Internucleoside Linkages

The naturally occurring internucleoside linkage of RNA and DNA is a 3' to 5' phosphodiester linkage. Antisense compounds having one or more modified, i.e. non-naturally occurring, internucleoside linkages are often selected over antisense compounds having naturally occurring internucleoside linkages because of desirable properties such as, for example, enhanced cellular uptake, enhanced affinity for target nucleic acids, and increased stability in the presence of nucleases.

Oligonucleotides having modified internucleoside linkages include internucleoside linkages that retain a phosphorus atom as well as internucleoside linkages that do not have a phosphorus atom. Representative phosphorus containing internucleoside linkages include, but are not limited to, phosphodiesters, phosphotriesters, methylphosphonates, phosphoramidate, and phosphorothioates. Methods of preparation of phosphorous-containing and non-phosphorous-containing linkages are well known.

In certain embodiments, antisense compounds targeted to a plasma prekallikrein nucleic acid comprise one or more modified internucleoside linkages. In certain embodiments, the modified internucleoside linkages are phosphorothioate linkages. In certain embodiments, each internucleoside linkage of an antisense compound is a phosphorothioate internucleoside linkage.

Modified Sugar Moieties

Antisense compounds can optionally contain one or more nucleosides wherein the sugar group has been modified. Such sugar modified nucleosides may impart enhanced nuclease stability, increased binding affinity, or some other beneficial biological property to the antisense compounds. In certain embodiments, nucleosides comprise chemically modified ribofuranose ring moieties. Examples of chemically modified ribofuranose rings include without limitation, addition of substitutent groups (including 5' and 2' substituent groups, bridging of non-geminal ring atoms to form bicyclic nucleic acids (BNA), replacement of the ribosyl ring oxygen atom with S, N(R), or C(R$_1$)(R$_2$) (R, R$_1$ and R$_2$ are each independently H, C$_1$-C$_{12}$ alkyl or a protecting group) and combinations thereof. Examples of chemically modified sugars include 2'-F-5'-methyl substituted nucleoside (see PCT International Application WO 2008/101157 Published on Aug. 21, 2008 for other disclosed 5',2'-bis substituted nucleosides) or replacement of the ribosyl ring oxygen atom with S with further substitution at the 2'-position (see published U.S. Patent Application US2005-0130923, published on Jun. 16, 2005) or alternatively 5'-substitution of a BNA (see PCT International Application WO 2007/134181 Published on Nov. 22, 2007 wherein LNA is substituted with for example a 5'-methyl or a 5'-vinyl group).

Examples of nucleosides having modified sugar moieties include without limitation nucleosides comprising 5'-vinyl, 5'-methyl (R or S), 4'-S, 2'-F, 2'-OCH$_3$, 2'-OCH$_2$CH$_3$, 2'-OCH$_2$CH$_2$F and 2'-O(CH$_2$)$_2$OCH$_3$ substituent groups. The substituent at the 2' position can also be selected from allyl, amino, azido, thio, O-allyl, O—C$_1$-C$_{10}$ alkyl, OCF$_3$, OCH$_2$F, O(CH$_2$)$_2$SCH$_3$, O(CH$_2$)$_2$—O—N(R$_m$)(R$_n$), O—CH$_2$—C(=O)—N(R$_m$)(R$_n$), and O—CH$_2$—C(=O)—N(R$_j$)—(CH$_2$)$_2$—N(R$_m$)(R$_n$), where each R$_j$, R$_m$ and R$_n$ is, independently, H or substituted or unsubstituted C$_1$-C$_{10}$ alkyl.

As used herein, "bicyclic nucleosides" refer to modified nucleosides comprising a bicyclic sugar moiety. Examples of bicyclic nucleosides include without limitation nucleosides comprising a bridge between the 4' and the 2' ribosyl ring atoms. In certain embodiments, antisense compounds provided herein include one or more bicyclic nucleosides comprising a 4' to 2' bridge. Examples of such 4' to 2' bridged bicyclic nucleosides, include but are not limited to one of the formulas: 4'-(CH$_2$)—O-2' (LNA); 4'-(CH$_2$)—S-2; 4'-(CH$_2$)$_2$—O-2' (ENA); 4'-CH(CH$_3$)—O-2' (also referred to as constrained ethyl or cEt) and 4'-CH(CH$_2$OCH$_3$)—O-2' (and analogs thereof see U.S. Pat. No. 7,399,845, issued on Jul. 15, 2008); 4'-C(CH$_3$)(CH$_3$)—O-2' (and analogs thereof see PCT/US2008/068922 published as WO/2009/006478, published Jan. 8, 2009); 4'-CH$_2$—N(OCH$_3$)-2' (and analogs thereof see PCT/US2008/064591 published as WO/2008/150729, published Dec. 11, 2008); 4'-CH$_2$—O—N(CH$_3$)-2' (see published U.S. Patent Application US2004-0171570, published Sep. 2, 2004); 4'-CH$_2$—N(R)—O-2', wherein R is H, C$_1$-C$_{12}$ alkyl, or a protecting group (see U.S. Pat. No. 7,427,672, issued on Sep. 23, 2008); 4'-CH$_2$—C(H)(CH$_3$)-2' (see Chattopadhyaya et al., *J. Org. Chem.*, 2009, 74, 118-134); and 4'-CH$_2$—C(=CH$_2$)-2' (and analogs thereof see PCT/US2008/066154 published as WO 2008/154401, published on Dec. 8, 2008).

Further reports related to bicyclic nucleosides can also be found in published literature (see for example: Frieden et al., *Nucleic Acids Research*, 2003, 21, 6365-6372; Singh et al., *Chem. Commun.*, 1998, 4, 455-456; Koshkin et al., *Tetrahedron*, 1998, 54, 3607-3630; Wahlestedt et al., *Proc. Natl. Acad. Sci. U.S.A.*, 2000, 97, 5633-5638; Kumar et al., *Bioorg. Med. Chem. Lett.*, 1998, 8, 2219-2222; Singh et al., *J. Org. Chem.*, 1998, 63, 10035-10039; Srivastava et al., *J. Am. Chem. Soc.*, 2007, 129(26) 8362-8379; Elayadi et al., *Curr. Opinion Invest. Drugs*, 2001, 2, 558-561; Braasch et al., *Chem. Biol.*, 2001, 8, 1-7; and Orum et al., *Curr. Opinion Mol. Ther.*, 2001, 3, 239-243; U.S. Pat. Nos. 6,268,490; 6,525,191; 6,670,461; 6,770,748; 6,794,499; 7,034,133; 7,053,207; 7,399,845; 7,547,684; and 7,696,345; U.S. Patent Publication No. US2008-0039618; US2009-0012281; US2007-0287831; US2004-0171570; U.S. patent application Ser. Nos. 12/129,154; 60/989,574; 61/026,995; 61/026,998; 61/056,564; 61/086,231; 61/097,787; and 61/099,844; Published PCT International applications WO 1994/014226; WO 2004/106356; WO 2005/021570; WO 2007/134181; WO 2008/150729; WO 2008/154401; and WO 2009/006478. Each of the foregoing bicyclic nucleosides can be prepared having one or more stereochemical sugar configurations including for example α-L-ribofuranose and β-D-ribofuranose (see PCT international application PCT/DK98/00393, published on Mar. 25, 1999 as WO 99/14226).

In certain embodiments, bicyclic sugar moieties of BNA nucleosides include, but are not limited to, compounds having at least one bridge between the 4' and the 2' position of the pentofuranosyl sugar moiety wherein such bridges independently comprise 1 or from 2 to 4 linked groups independently selected from —[C(R$_a$)(R$_b$)]$_n$—, —C(R$_a$)=C(R$_b$)—, —C(R$_a$)=N—, —C(=O)—, —C(=NR$_a$)—, —C(=S)—, —O—, —Si(R$_a$)$_2$—, —S(=O)$_x$—, and —N(R$_a$)—;

wherein:

x is 0, 1, or 2;

n is 1, 2, 3, or 4;

each R$_a$ and R$_b$ is, independently, H, a protecting group, hydroxyl, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, heterocycle radical, substituted heterocycle radical, heteroaryl, substituted heteroaryl, C$_5$-C$_7$ alicyclic radical, substituted C$_5$-C$_7$ alicyclic radical, halogen, OJ$_1$, NJ$_1$J$_2$, SJ$_1$, N$_3$, COOJ$_1$, acyl (C(=O)—H), substituted acyl, CN, sulfonyl (S(=O)$_2$-J$_1$), or sulfoxyl (S(=O)-J$_1$); and each J$_1$ and J$_2$ is, independently, H, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, acyl (C(=O)—H), substituted acyl, a heterocycle radical, a substituted heterocycle radical, C$_1$-C$_{12}$ aminoalkyl, substituted C$_1$-C$_{12}$ aminoalkyl or a protecting group.

In certain embodiments, the bridge of a bicyclic sugar moiety is —[C(R$_a$)(R$_b$)]$_n$—, —[C(R$_a$)(R$_b$)]$_n$—O—, —C(R$_a$R$_b$)—N(R)—O— or —C(R$_a$R$_b$)—O—N(R)—. In certain embodiments, the bridge is 4'-CH$_2$-2', 4'-(CH$_2$)$_2$-2', 4'-(CH$_2$)$_3$-2', 4'-CH$_2$—O-2', 4'-(CH$_2$)$_2$—O-2', 4'-CH$_2$—O—N(R)-2' and 4'-CH$_2$—N(R)—O-2'- wherein each R is, independently, H, a protecting group or C$_1$-C$_{12}$ alkyl.

In certain embodiments, bicyclic nucleosides are further defined by isomeric configuration. For example, a nucleoside comprising a 4'-2' methylene-oxy bridge, may be in the α-L configuration or in the β-D configuration. Previously, α-L-methyleneoxy (4'-CH$_2$—O-2') BNA's have been incorporated into antisense oligonucleotides that showed antisense activity (Frieden et al., *Nucleic Acids Research*, 2003, 21, 6365-6372).

In certain embodiments, bicyclic nucleosides include, but are not limited to, (A) α-L-methyleneoxy (4'-CH$_2$—O-2') BNA, (B) β-D-methyleneoxy (4'-CH$_2$—O-2') BNA, (C) ethyleneoxy (4'-(CH$_2$)$_2$—O-2') BNA, (D) aminooxy (4'-CH$_2$—O—N(R)-2') BNA, (E) oxyamino (4'-CH$_2$—N(R)—O-2') BNA, and (F) methyl(methyleneoxy) (4'-CH(CH$_3$)—O-2') BNA, (G) methylene-thio (4'-CH$_2$—S-2') BNA, (H) methylene-amino (4'-CH$_2$—N(R)-2') BNA, (I) methyl carbocyclic (4'-CH$_2$—CH(CH$_3$)-2') BNA, (J) propylene carbocyclic (4'-(CH$_2$)$_3$-2') BNA and (K) vinyl BNA as depicted below:

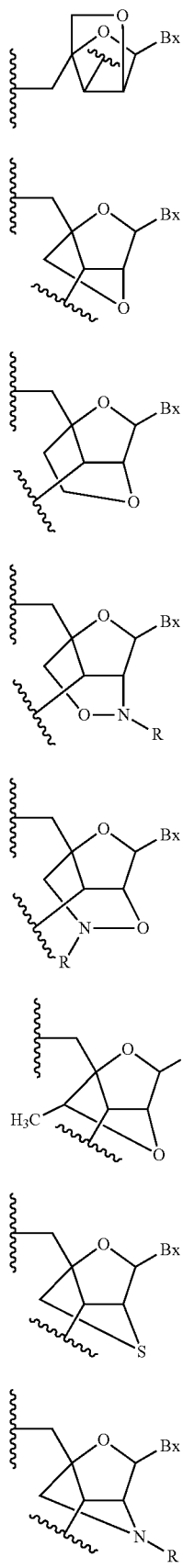

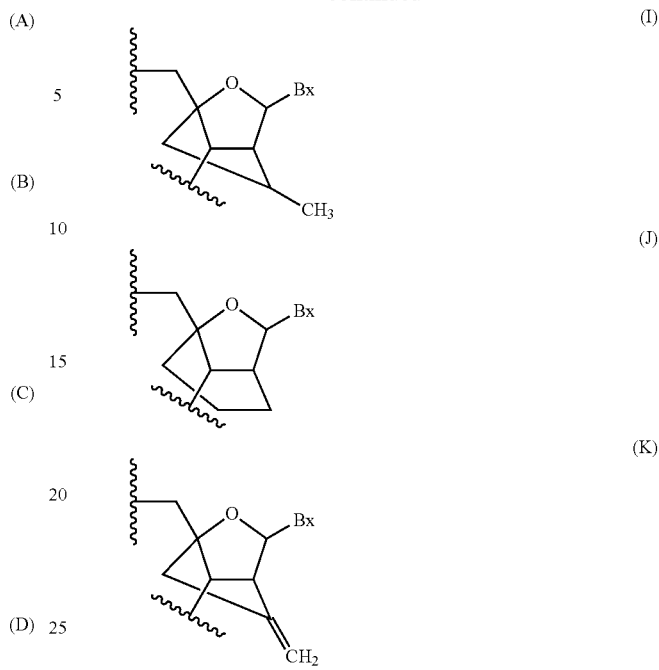

wherein Bx is the base moiety and R is independently H, a protecting group, $C_1$-$C_{12}$ alkyl or $C_1$-$C_{12}$ alkoxy.

In certain embodiments, bicyclic nucleosides are provided having Formula I:

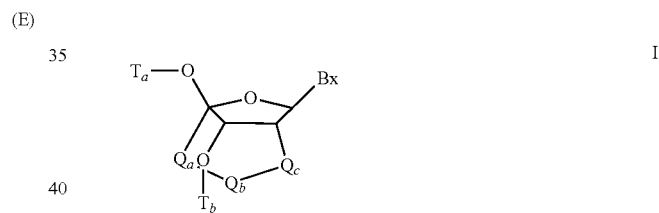

wherein:

Bx is a heterocyclic base moiety;

-$Q_a$-$Q_b$-$Q_c$- is —$CH_2$—N($R_c$)—$CH_2$—, —C(=O)—N($R_c$)—$CH_2$—, —$CH_2$—O—N($R_c$)—, —$CH_2$—N($R_c$)—O— or —N($R_c$)—O—$CH_2$;

$R_c$ is $C_1$-$C_{12}$ alkyl or an amino protecting group; and $T_a$ and $T_b$ are each, independently H, a hydroxyl protecting group, a conjugate group, a reactive phosphorus group, a phosphorus moiety or a covalent attachment to a support medium.

In certain embodiments, bicyclic nucleosides are provided having Formula II:

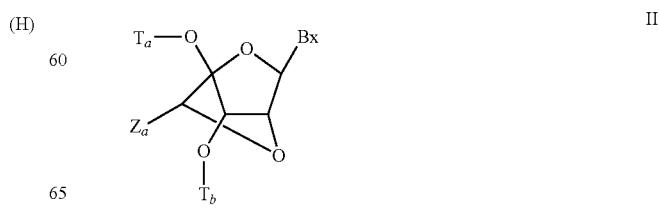

wherein:

Bx is a heterocyclic base moiety;

$T_a$ and $T_b$ are each, independently H, a hydroxyl protecting group, a conjugate group, a reactive phosphorus group, a phosphorus moiety or a covalent attachment to a support medium;

$Z_a$ is $C_1$-$C_6$ alkyl, $C_2$-$C_6$ alkenyl, $C_2$-$C_6$ alkynyl, substituted $C_1$-$C_6$ alkyl, substituted $C_2$-$C_6$ alkenyl, substituted $C_2$-$C_6$ alkynyl, acyl, substituted acyl, substituted amide, thiol or substituted thio.

In one embodiment, each of the substituted groups is, independently, mono or poly substituted with substituent groups independently selected from halogen, oxo, hydroxyl, $OJ_c$, $NJ_cJ_d$, $SJ_c$, $N_3$, $OC(=X)J_c$ and $NJ_eC(=X)NJ_cJ_d$, wherein each $J_c$, $J_d$ and $J_e$ is, independently, H, $C_1$-$C_6$ alkyl, or substituted $C_1$-$C_6$ alkyl and X is O or $NJ_c$.

In certain embodiments, bicyclic nucleosides are provided having Formula III:

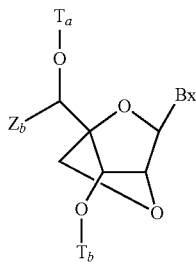

wherein:

Bx is a heterocyclic base moiety;

$T_a$ and $T_b$ are each, independently H, a hydroxyl protecting group, a conjugate group, a reactive phosphorus group, a phosphorus moiety or a covalent attachment to a support medium;

$Z_b$ is $C_1$-$C_6$ alkyl, $C_2$-$C_6$ alkenyl, $C_2$-$C_6$ alkynyl, substituted $C_1$-$C_6$ alkyl, substituted $C_2$-$C_6$ alkenyl, substituted $C_2$-$C_6$ alkynyl or substituted acyl (C(=O)—).

In certain embodiments, bicyclic nucleosides are provided having Formula IV:

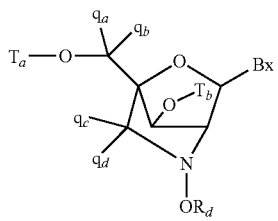

wherein:

Bx is a heterocyclic base moiety;

$T_a$ and $T_b$ are each, independently H, a hydroxyl protecting group, a conjugate group, a reactive phosphorus group, a phosphorus moiety or a covalent attachment to a support medium;

$R_d$ is $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl or substituted $C_2$-$C_6$ alkynyl;

each $q_a$, $q_b$, $q_c$ and $q_d$ is, independently, H, halogen, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl or substituted $C_2$-$C_6$ alkynyl, $C_1$-$C_6$ alkoxyl, substituted $C_1$-$C_6$ alkoxyl, acyl, substituted acyl, $C_1$-$C_6$ aminoalkyl or substituted $C_1$-$C_6$ aminoalkyl;

In certain embodiments, bicyclic nucleosides are provided having Formula V:

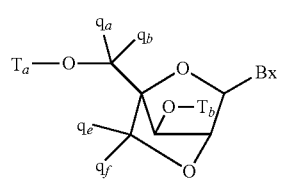

wherein:

Bx is a heterocyclic base moiety;

$T_a$ and $T_b$ are each, independently H, a hydroxyl protecting group, a conjugate group, a reactive phosphorus group, a phosphorus moiety or a covalent attachment to a support medium;

$q_a$, $q_b$, $q_c$ and $q_f$ are each, independently, hydrogen, halogen, $C_1$-$C_{12}$ alkyl, substituted $C_1$-$C_{12}$ alkyl, $C_2$-$C_{12}$ alkenyl, substituted $C_2$-$C_{12}$ alkenyl, $C_2$-$C_{12}$ alkynyl, substituted $C_2$-$C_{12}$ alkynyl, $C_1$-$C_{12}$ alkoxy, substituted $C_1$-$C_{12}$ alkoxy, $OJ_j$, $SJ_j$, $SOJ_j$, $SO_2J_j$, $NJ_jJ_k$, $N_3$, CN, $C(=O)OJ_j$, $C(=O)NJ_jJ_k$, $C(=O)J_j$, $O—C(=O)NJ_jJ_k$, $N(H)C(=NH)NJ_jJ_k$, $N(H)C(=O)NJ_jJ_k$ or $N(H)C(=S)NJ_jJ_k$;

or $q_e$ and $q_f$ together are $=C(q_g)(q_h)$;

$q_g$ and $q_h$ are each, independently, H, halogen, $C_1$-$C_{12}$ alkyl or substituted $C_1$-$C_{12}$ alkyl.

The synthesis and preparation of the methyleneoxy (4'-CH$_2$—O-2') BNA monomers adenine, cytosine, guanine, 5-methyl-cytosine, thymine and uracil, along with their oligomerization, and nucleic acid recognition properties have been described (Koshkin et al., *Tetrahedron,* 1998, 54, 3607-3630). BNAs and preparation thereof are also described in WO 98/39352 and WO 99/14226.

Analogs of methyleneoxy (4'-CH$_2$—O-2') BNA and 2'-thio-BNAs, have also been prepared (Kumar et al., *Bioorg. Med. Chem. Lett.,* 1998, 8, 2219-2222). Preparation of locked nucleoside analogs comprising oligodeoxyribonucleotide duplexes as substrates for nucleic acid polymerases has also been described (Wengel et al., WO 99/14226). Furthermore, synthesis of 2'-amino-BNA, a novel conformationally restricted high-affinity oligonucleotide analog has been described in the art (Singh et al., *J. Org. Chem.,* 1998, 63, 10035-10039). In addition, 2'-amino- and 2'-methylamino-BNA's have been prepared and the thermal stability of their duplexes with complementary RNA and DNA strands has been previously reported.

In certain embodiments, bicyclic nucleosides are provided having Formula VI:

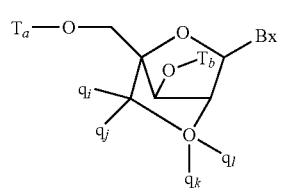

wherein:

Bx is a heterocyclic base moiety;

$T_a$ and $T_b$ are each, independently H, a hydroxyl protecting group, a conjugate group, a reactive phosphorus group, a phosphorus moiety or a covalent attachment to a support medium;

each $q_i$, $q_j$, $q_k$ and $q_l$ is, independently, H, halogen, $C_1$-$C_{12}$ alkyl, substituted $C_1$-$C_{12}$ alkyl, $C_2$-$C_{12}$ alkenyl, substituted $C_2$-$C_{12}$ alkenyl, $C_2$-$C_{12}$ alkynyl, substituted $C_2$-$C_{12}$ alkynyl, $C_1$-$C_{12}$ alkoxyl, substituted $C_1$-$C_{12}$ alkoxyl, $OJ_j$, $SJ_j$, $SOJ_j$, $SO_2J_j$, $NJ_jJ_k$, $N_3$, CN, C(=O)$OJ_j$, C(=O)$NJ_jJ_k$, C(=O)$J_j$, O—C(=O)$NJ_jJ_k$, N(H)C(=NH)$NJ_jJ_k$, N(H)C(=O)$NJ_jJ_k$ or N(H)C(=S)$NJ_jJ_k$; and $q_i$ and $q_j$ or $q_l$ and $q_k$ together are =C($q_g$)($q_h$), wherein $q_g$ and $q_h$ are each, independently, H, halogen, $C_1$-$C_{12}$ alkyl or substituted $C_1$-$C_{12}$ alkyl.

One carbocyclic bicyclic nucleoside having a 4'-(CH$_2$)$_3$-2' bridge and the alkenyl analog bridge 4'-CH=CH—CH$_2$-2' have been described (Freier et al., *Nucleic Acids Research*, 1997, 25(22), 4429-4443 and Albaek et al., *J. Org. Chem.*, 2006, 71, 7731-7740). The synthesis and preparation of carbocyclic bicyclic nucleosides along with their oligomerization and biochemical studies have also been described (Srivastava et al., *J. Am. Chem. Soc.*, 2007, 129(26), 8362-8379).

As used herein, "4'-2' bicyclic nucleoside" or "4' to 2' bicyclic nucleoside" refers to a bicyclic nucleoside comprising a furanose ring comprising a bridge connecting two carbon atoms of the furanose ring connects the 2' carbon atom and the 4' carbon atom of the sugar ring.

As used herein, "monocyclic nucleosides" refer to nucleosides comprising modified sugar moieties that are not bicyclic sugar moieties. In certain embodiments, the sugar moiety, or sugar moiety analogue, of a nucleoside may be modified or substituted at any position.

As used herein, "2'-modified sugar" means a furanosyl sugar modified at the 2' position. In certain embodiments, such modifications include substituents selected from: a halide, including, but not limited to substituted and unsubstituted alkoxy, substituted and unsubstituted thioalkyl, substituted and unsubstituted amino alkyl, substituted and unsubstituted alkyl, substituted and unsubstituted allyl, and substituted and unsubstituted alkynyl. In certain embodiments, 2' modifications are selected from substituents including, but not limited to: O[(CH$_2$)$_n$O]$_m$CH$_3$, O(CH$_2$)$_n$NH$_2$, O(CH$_2$)$_n$CH$_3$, O(CH$_2$)$_n$F, O(CH$_2$)$_n$ONH$_2$, OCH$_2$C(=O)N(H)CH$_3$, and O(CH$_2$)$_n$ON[(CH$_2$)$_n$CH$_3$]$_2$, where n and m are from 1 to about 10. Other 2'-substituent groups can also be selected from: $C_1$-$C_{12}$ alkyl, substituted alkyl, alkenyl, alkynyl, alkaryl, aralkyl, O-alkaryl or O-aralkyl, SH, SCH$_3$, OCN, Cl, Br, CN, F, CF$_3$, OCF$_3$, SOCH$_3$, SO$_2$CH$_3$, ONO$_2$, NO$_2$, N$_3$, NH$_2$, heterocycloalkyl, heterocycloalkaryl, aminoalkylamino, polyalkylamino, substituted silyl, an RNA cleaving group, a reporter group, an intercalator, a group for improving pharmacokinetic properties, or a group for improving the pharmacodynamic properties of an antisense compound, and other substituents having similar properties. In certain embodiments, modified nucleosides comprise a 2'-MOE side chain (Baker et al., *J. Biol. Chem.*, 1997, 272, 11944-12000). Such 2'-MOE substitution have been described as having improved binding affinity compared to unmodified nucleosides and to other modified nucleosides, such as 2'-O-methyl, O-propyl, and O-aminopropyl. Oligonucleotides having the 2'-MOE substituent also have been shown to be antisense inhibitors of gene expression with promising features for in vivo use (Martin, *Helv. Chim. Acta*, 1995, 78, 486-504; Altmann et al., *Chimia*, 1996, 50, 168-176; Altmann et al., *Biochem. Soc. Trans.*, 1996, 24, 630-637; and Altmann et al., *Nucleosides Nucleotides*, 1997, 16, 917-926).

As used herein, a "modified tetrahydropyran nucleoside" or "modified THP nucleoside" means a nucleoside having a six-membered tetrahydropyran "sugar" substituted in for the pentofuranosyl residue in normal nucleosides (a sugar surrogate). Modified THP nucleosides include, but are not limited to, what is referred to in the art as hexitol nucleic acid (HNA), anitol nucleic acid (ANA), manitol nucleic acid (MNA) (see Leumann, *Bioorg. Med. Chem.*, 2002, 10, 841-1954) or fluoro HNA (F-HNA) having a tetrahydropyran ring system as illustrated below:

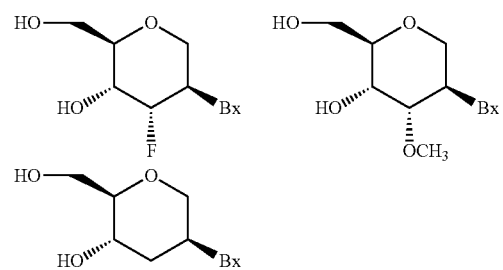

In certain embodiments, sugar surrogates are selected having Formula VII:

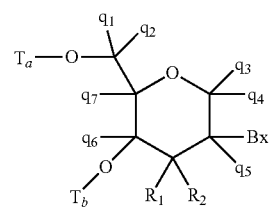

VII wherein independently for each of said at least one tetrahydropyran nucleoside analog of Formula VII:

Bx is a heterocyclic base moiety;

$T_a$ and $T_b$ are each, independently, an internucleoside linking group linking the tetrahydropyran nucleoside analog to the antisense compound or one of $T_a$ and $T_b$ is an internucleoside linking group linking the tetrahydropyran nucleoside analog to the antisense compound and the other of $T_a$ and $T_b$ is H, a hydroxyl protecting group, a linked conjugate group or a 5' or 3'-terminal group;

$q_1$, $q_2$, $q_3$, $q_4$, $q_5$, $q_6$ and $q_7$ are each independently, H, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl or substituted $C_2$-$C_6$ alkynyl; and each of $R_1$ and $R_2$ is selected from hydrogen, hydroxyl, halogen, substituted or unsubstituted alkoxy, $NJ_1J_2$, $SJ_1$, $N_3$, OC(=X)$J_1$, OC(=X)$NJ_1J_2$, $NJ_3$C(=X)$NJ_1J_2$ and CN, wherein X is O, S or $NJ_1$ and each $J_1$, $J_2$ and $J_3$ is, independently, H or $C_1$-$C_6$ alkyl.

In certain embodiments, the modified THP nucleosides of Formula VII are provided wherein $q_1$, $q_2$, $q_3$, $q_4$, $q_5$, $q_6$ and $q_7$ are each H. In certain embodiments, at least one of $q_1$, $q_2$, $q_3$, $q_4$, $q_5$, $q_6$ and $q_7$ is other than H. In certain embodiments, at least one of $q_1$, $q_2$, $q_3$, $q_4$, $q_5$, $q_6$ and $q_7$ is methyl. In certain embodiments, THP nucleosides of Formula VII are provided wherein one of $R_1$ and $R_2$ is fluoro. In certain embodiments, $R_1$ is fluoro and $R_2$ is H; $R_1$ is methoxy and $R_2$ is H, and $R_1$ is methoxyethoxy and $R_2$ is H.

In certain embodiments, sugar surrogates comprise rings having more than 5 atoms and more than one heteroatom. For example nucleosides comprising morpholino sugar moieties and their use in oligomeric compounds has been reported (see for example: Braasch et al., *Biochemistry*, 2002, 41, 4503-4510; and U.S. Pat. Nos. 5,698,685; 5,166,315; 5,185,444; and 5,034,506). As used here, the term "morpholino" means a sugar surrogate having the following formula:

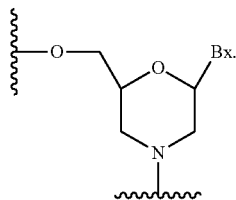

In certain embodiments, morpholinos may be modified, for example by adding or altering various substituent groups from the above morpholino structure. Such sugar surrogates are referred to herein as "modified morpholinos."

Combinations of modifications are also provided without limitation, such as 2'-F-5'-methyl substituted nucleosides (see PCT International Application WO 2008/101157 published on Aug. 21, 2008 for other disclosed 5', 2'-bis substituted nucleosides) and replacement of the ribosyl ring oxygen atom with S and further substitution at the 2'-position (see published U.S. Patent Application US2005-0130923, published on Jun. 16, 2005) or alternatively 5'-substitution of a bicyclic nucleic acid (see PCT International Application WO 2007/134181, published on Nov. 22, 2007 wherein a 4'-CH$_2$—O-2' bicyclic nucleoside is further substituted at the 5' position with a 5'-methyl or a 5'-vinyl group). The synthesis and preparation of carbocyclic bicyclic nucleosides along with their oligomerization and biochemical studies have also been described (see, e.g., Srivastava et al., *J. Am. Chem. Soc.* 2007, 129(26), 8362-8379).

In certain embodiments, antisense compounds comprise one or more modified cyclohexenyl nucleosides, which is a nucleoside having a six-membered cyclohexenyl in place of the pentofuranosyl residue in naturally occurring nucleosides. Modified cyclohexenyl nucleosides include, but are not limited to those described in the art (see for example commonly owned, published PCT Application WO 2010/036696, published on Apr. 10, 2010, Robeyns et al., *J. Am. Chem. Soc.*, 2008, 130(6), 1979-1984; Horvath et al., *Tetrahedron Letters*, 2007, 48, 3621-3623; Nauwelaerts et al., *J. Am. Chem. Soc.*, 2007, 129(30), 9340-9348; Gu et al., *Nucleosides, Nucleotides & Nucleic Acids*, 2005, 24(5-7), 993-998; Nauwelaerts et al., *Nucleic Acids Research*, 2005, 33(8), 2452-2463; Robeyns et al., *Acta Crystallographica, Section F: Structural Biology and Crystallization Communications*, 2005, F61(6), 585-586; Gu et al., *Tetrahedron*, 2004, 60(9), 2111-2123; Gu et al., *Oligonucleotides*, 2003, 13(6), 479-489; Wang et al., *J. Org. Chem.*, 2003, 68, 4499-4505; Verbeure et al., *Nucleic Acids Research*, 2001, 29(24), 4941-4947; Wang et al., *J. Org. Chem.*, 2001, 66, 8478-82; Wang et al., *Nucleosides, Nucleotides & Nucleic Acids*, 2001, 20(4-7), 785-788; Wang et al., *J. Am. Chem.*, 2000, 122, 8595-8602; Published PCT application, WO 06/047842; and Published PCT Application WO 01/049687; the text of each is incorporated by reference herein, in their entirety). Certain modified cyclohexenyl nucleosides have Formula X.

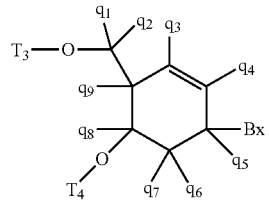

wherein independently for each of said at least one cyclohexenyl nucleoside analog of Formula X:

Bx is a heterocyclic base moiety;

$T_3$ and $T_4$ are each, independently, an internucleoside linking group linking the cyclohexenyl nucleoside analog to an antisense compound or one of $T_3$ and $T_4$ is an internucleoside linking group linking the tetrahydropyran nucleoside analog to an antisense compound and the other of $T_3$ and $T_4$ is H, a hydroxyl protecting group, a linked conjugate group, or a 5'- or 3'-terminal group; and $q_1$, $q_2$, $q_3$, $q_4$, $q_5$, $q_6$, $q_7$, $q_8$ and $q_9$ are each, independently, H, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl, substituted $C_2$-$C_6$ alkynyl or other sugar substituent group.

As used herein, "2'-modified" or "2'-substituted" refers to a nucleoside comprising a sugar comprising a substituent at the 2' position other than H or OH. 2'-modified nucleosides, include, but are not limited to, bicyclic nucleosides wherein the bridge connecting two carbon atoms of the sugar ring connects the 2' carbon and another carbon of the sugar ring; and nucleosides with non-bridging 2' substituents, such as allyl, amino, azido, thio, O-allyl, O—$C_1$-$C_{10}$ alkyl, —OCF$_3$, O—(CH$_2$)$_2$—O—CH$_3$, 2'-O(CH$_2$)$_2$SCH$_3$, O—(CH$_2$)$_2$—O—N(R$_m$)(R$_n$), or O—CH$_2$—C(=O)—N(R$_m$)(R$_n$), where each R$_m$ and R$_n$ is, independently, H or substituted or unsubstituted $C_1$-$C_{10}$ alkyl. 2'-modified nucleosides may further comprise other modifications, for example at other positions of the sugar and/or at the nucleobase.

As used herein, "2'-F" refers to a nucleoside comprising a sugar comprising a fluoro group at the 2' position of the sugar ring.

As used herein, "2'-OMe" or "2'-OCH$_3$" or "2'-O-methyl" each refers to a nucleoside comprising a sugar comprising an —OCH$_3$ group at the 2' position of the sugar ring.

As used herein, "MOE" or "2'-MOE" or "2'-OCH$_2$CH$_2$OCH$_3$" or "2'-O-methoxyethyl" each refers to a nucleoside comprising a sugar comprising a —OCH$_2$CH$_2$OCH$_3$ group at the 2' position of the sugar ring.

As used herein, "oligonucleotide" refers to a compound comprising a plurality of linked nucleosides.

In certain embodiments, one or more of the plurality of nucleosides is modified. In certain embodiments, an oligonucleotide comprises one or more ribonucleosides (RNA) and/or deoxyribonucleosides (DNA).

Many other monocyclo, bicyclo and tricyclo sugar surrogate ring systems are also known in the art that can be used to modify nucleosides for incorporation into antisense compounds as provided herein (see for example review article: Leumann, *Bioorg. Med. Chem.*, 2002, 10, 841-1954). Such ring systems can undergo various additional substitutions to enhance activity.

Methods for the preparations of modified sugars are well known to those skilled in the art. Some representative U.S. patents that teach the preparation of such modified sugars include without limitation, U.S. Pat. Nos. 4,981,957; 5,118,800; 5,319,080; 5,359,044; 5,393,878; 5,446,137; 5,466, 786; 5,514,785; 5,519,134; 5,567,811; 5,576,427; 5,591,722; 5,597,909; 5,610,300; 5,627,053; 5,639,873; 5,646,265; 5,670,633; 5,700,920; 5,792,847 and 6,600,032 and International Application PCT/US2005/019219, filed Jun. 2, 2005 and published as WO 2005/121371 on Dec. 22, 2005, and each of which is herein incorporated by reference in its entirety.

In nucleotides having modified sugar moieties, the nucleobase moieties (natural, modified or a combination thereof) are maintained for hybridization with an appropriate nucleic acid target.

In certain embodiments, antisense compounds comprise one or more nucleosides having modified sugar moieties. In certain embodiments, the modified sugar moiety is 2'-MOE. In certain embodiments, the 2'-MOE modified nucleosides are arranged in a gapmer motif. In certain embodiments, the modified sugar moiety is a bicyclic nucleoside having a (4'-CH(CH$_3$)—O-2') bridging group. In certain embodiments, the (4'-CH(CH$_3$)—O-2') modified nucleosides are arranged throughout the wings of a gapmer motif.

Conjugated Antisense Compounds

Antisense compounds may be covalently linked to one or more moieties or conjugates which enhance the activity, cellular distribution or cellular uptake of the resulting antisense oligonucleotides. Typical conjugate groups include cholesterol moieties and lipid moieties. Additional conjugate groups include carbohydrates, phospholipids, biotin, phenazine, folate, phenanthridine, anthraquinone, acridine, fluoresceins, rhodamines, coumarins, and dyes.

Antisense compounds can also be modified to have one or more stabilizing groups that are generally attached to one or both termini of antisense compounds to enhance properties such as, for example, nuclease stability. Included in stabilizing groups are cap structures. These terminal modifications protect the antisense compound having terminal nucleic acid from exonuclease degradation, and can help in delivery and/or localization within a cell. The cap can be present at the 5'-terminus (5'-cap), or at the 3'-terminus (3'-cap), or can be present on both termini. Cap structures are well known in the art and include, for example, inverted deoxy abasic caps. Further 3' and 5'-stabilizing groups that can be used to cap one or both ends of an antisense compound to impart nuclease stability include those disclosed in WO 03/004602 published on Jan. 16, 2003.

Cell Culture and Antisense Compounds Treatment

The effects of antisense compounds on the level, activity, or expression of PKK nucleic acids can be tested in vitro in a variety of cell types. Cell types used for such analyses are available from commercial vendors (e.g., American Type Culture Collection, Manassas, Va.; Zen-Bio, Inc., Research Triangle Park, N.C.; Clonetics Corporation, Walkersville, Md.) and are cultured according to the vendor's instructions using commercially available reagents (e.g., Life Technologies, Carlsbad, Calif.). Illustrative cell types include, but are not limited to, HepaRG™T cells and mouse primary hepatocytes.

In Vitro Testing of Antisense Oligonucleotides

Described herein are methods for treatment of cells with antisense oligonucleotides, which can be modified appropriately for treatment with other antisense compounds.

Cells may be treated with antisense oligonucleotides when the cells reach approximately 60-80% confluency in culture.

One reagent commonly used to introduce antisense oligonucleotides into cultured cells includes the cationic lipid transfection reagent LIPOFECTIN (Life Technologies, Carlsbad, Calif.). Antisense oligonucleotides may be mixed with LIPOFECTIN in OPTI-MEM 1 (Life Technologies, Carlsbad, Calif.) to achieve the desired final concentration of antisense oligonucleotide and a LIPOFECTIN concentration that may range from 2 to 12 ug/mL per 100 nM antisense oligonucleotide.

Another reagent used to introduce antisense oligonucleotides into cultured cells includes LIPOFECTAMINE (Life Technologies, Carlsbad, Calif.). Antisense oligonucleotide is mixed with LIPOFECTAMINE in OPTI-MEM 1 reduced serum medium (Life Technologies, Carlsbad, Calif.) to achieve the desired concentration of antisense oligonucleotide and a LIPOFECTAMINE concentration that may range from 2 to 12 ug/mL per 100 nM antisense oligonucleotide.

Another technique used to introduce antisense oligonucleotides into cultured cells includes electroporation.

Yet another technique used to introduce antisense oligonucleotides into cultured cells includes free uptake of the oligonucleotides by the cells.

Cells are treated with antisense oligonucleotides by routine methods. Cells may be harvested 16-24 hours after antisense oligonucleotide treatment, at which time RNA or protein levels of target nucleic acids are measured by methods known in the art and described herein. In general, when treatments are performed in multiple replicates, the data are presented as the average of the replicate treatments.

The concentration of antisense oligonucleotide used varies from cell line to cell line. Methods to determine the optimal antisense oligonucleotide concentration for a particular cell line are well known in the art. Antisense oligonucleotides are typically used at concentrations ranging from 1 nM to 300 nM when transfected with LIPOFECTAMINE. Antisense oligonucleotides are used at higher concentrations ranging from 625 to 20,000 nM when transfected using electroporation.

RNA Isolation

RNA analysis can be performed on total cellular RNA or poly(A)+ mRNA. Methods of RNA isolation are well known in the art. RNA is prepared using methods well known in the art, for example, using the TRIZOL Reagent (Life Technologies, Carlsbad, Calif.) according to the manufacturer's recommended protocols.

Analysis of Inhibition of Target Levels or Expression

Inhibition of levels or expression of a PKK nucleic acid can be assayed in a variety of ways known in the art. For example, target nucleic acid levels can be quantitated by, e.g., Northern blot analysis, competitive polymerase chain reaction (PCR), or quantitative real-time PCR. RNA analysis can be performed on total cellular RNA or poly(A)+ mRNA. Methods of RNA isolation are well known in the art. Northern blot analysis is also routine in the art. Quantitative real-time PCR can be conveniently accomplished using the commercially available ABI PRISM 7600, 7700, or 7900 Sequence Detection System, available from PE-Applied Biosystems, Foster City, Calif. and used according to manufacturer's instructions.

Quantitative Real-Time PCR Analysis of Target RNA Levels

Quantitation of target RNA levels may be accomplished by quantitative real-time PCR using the ABI PRISM 7600, 7700, or 7900 Sequence Detection System (PE-Applied Biosystems, Foster City, Calif.) according to manufacturer's instructions. Methods of quantitative real-time PCR are well known in the art.

Prior to real-time PCR, the isolated RNA is subjected to a reverse transcriptase (RT) reaction, which produces complementary DNA (cDNA) that is then used as the substrate for the real-time PCR amplification. The RT and real-time PCR reactions are performed sequentially in the same sample well. RT and real-time PCR reagents may be obtained from Life Technologies (Carlsbad, Calif.). RT real-time-PCR reactions are carried out by methods well known to those skilled in the art.

Gene (or RNA) target quantities obtained by real time PCR are normalized using either the expression level of a gene whose expression is constant, such as cyclophilin A, or by quantifying total RNA using RIBOGREEN (Life Technologies, Inc. Carlsbad, Calif.). Cyclophilin A expression is quantified by real time PCR, by being run simultaneously with the target, multiplexing, or separately. Total RNA is quantified using RIBOGREEN RNA quantification reagent (Invetrogen, Inc. Eugene, Oreg.). Methods of RNA quantification by RIBOGREEN are taught in Jones, L. J., et al, (Analytical Biochemistry, 1998, 265, 368-374). A CYTO-FLUOR 4000 instrument (PE Applied Biosystems) is used to measure RIBOGREEN fluorescence.

Probes and primers are designed to hybridize to a PKK nucleic acid. Methods for designing real-time PCR probes and primers are well known in the art, and may include the use of software such as PRIMER EXPRESS Software (Applied Biosystems, Foster City, Calif.).

Analysis of Protein Levels

Antisense inhibition of PKK nucleic acids can be assessed by measuring PKK protein levels. Protein levels of PKK can be evaluated or quantitated in a variety of ways well known in the art, such as immunoprecipitation, Western blot analysis (immunoblotting), enzyme-linked immunosorbent assay (ELISA), quantitative protein assays, protein activity assays (for example, caspase activity assays), immunohistochemistry, immunocytochemistry or fluorescence-activated cell sorting (FACS). Antibodies directed to a target can be identified and obtained from a variety of sources, such as the MSRS catalog of antibodies (Aerie Corporation, Birmingham, Mich.), or can be prepared via conventional monoclonal or polyclonal antibody generation methods well known in the art.

In Vivo Testing of Antisense Compounds

Antisense compounds, for example, antisense oligonucleotides, are tested in animals to assess their ability to inhibit expression of PKK and produce phenotypic changes.

In certain embodiments, such phenotypic changes include those associated with an inflammatory disease, such as, reduced inflammation, edema/swelling, vascular permeability, and vascular leakage. In certain embodiments, inflammation is measured by measuring the increase or decrease of edema, temperature, pain, color of tissue, and abdominal function in the animal.

In certain embodiments, such phenotypic changes include those associated with a thromboembolic disease, such as, prolonged aPTT, prolonged aPTT time in conjunction with a normal PT, decreased quantity of Platelet Factor 4 (PF-4), and reduced formation of thrombus or increased time for thrombus formation.

Testing may be performed in normal animals, or in experimental disease models. For administration to animals, antisense oligonucleotides are formulated in a pharmaceutically acceptable diluent, such as phosphate-buffered saline. Administration includes parenteral routes of administration, such as intraperitoneal, intravenous, and subcutaneous. Calculation of antisense oligonucleotide dosage and dosing frequency is within the abilities of those skilled in the art, and depends upon factors such as route of administration and animal body weight. Following a period of treatment with antisense oligonucleotides, RNA is isolated from liver tissue and changes in PKK nucleic acid expression are measured.

Certain Indications

In certain embodiments, the invention provides methods of treating an individual comprising administering one or more pharmaceutical compositions as described herein.

In certain embodiments, the individual has an inflammatory disease. In certain embodiments, the individual is at risk for developing an inflammatory condition, including, but not limited to hereditary angioedema (HAE), edema, angioedema, swelling, angioedema of the lids, ocular edema, macular edema, and cerebral edema. This includes individuals with an acquired problem, disease, or disorder that leads to a risk of inflammation, for example, genetic predisposition to an inflammatory condition, environmental factors, and exposure to certain medications, including, for example, ACE inhibitors and ARBs. In certain embodiments, the individual has been identified as in need of anti-inflammation therapy. Examples of such individuals include, but are not limited to those having a mutation in the genetic code for complement 1 esterase inhibitor (i.e., C1-INH) or Factor 12. In certain embodiments, an abnormal code can lead to a deficiency in C1-INH (i.e., type I HAE), an inability of existing C1-INH to function properly (type II HAE), or hyperfunctional Factor 12 (i.e., type III HAE).

In certain embodiments, the individual has a thromboembolic disease. In certain embodiments, the individual is at risk for a blood clotting disorder, including, but not limited to, infarct, thrombosis, embolism, thromboembolism such as deep vein thrombosis, pulmonary embolism, myocardial infarction, and stroke. This includes individuals with an acquired problem, disease, or disorder that leads to a risk of thrombosis, for example, surgery, cancer, immobility, sepsis, atherosclerosis atrial fibrillation, as well as genetic predisposition, for example, antiphospholipid syndrome and the autosomal dominant condition, Factor V Leiden. In certain embodiments, the individual has been identified as in need of anticoagulation therapy. Examples of such individuals include, but are not limited to, those undergoing major orthopedic surgery (e.g., hip/knee replacement or hip fracture surgery) and patients in need of chronic treatment, such as those suffering from arterial fibrillation to prevent stroke.

In certain embodiments the invention provides methods for prophylactically reducing PKK expression in an individual. Certain embodiments include treating an individual in need thereof by administering to an individual a therapeutically effective amount of an antisense compound targeted to a PKK nucleic acid.

In one embodiment, administration of a therapeutically effective amount of an antisense compound targeted to a PKK nucleic acid is accompanied by monitoring of PKK levels in the serum of an individual, to determine an individual's response to administration of the antisense compound. An individual's response to administration of the antisense compound is used by a physician to determine the amount and duration of therapeutic intervention.

In certain embodiments, administration of an antisense compound targeted to a PKK nucleic acid results in reduction of PKK expression by at least 15, 20, 25, 30, 35, 40, 45, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, or 99%, or a range defined by any two of these values. In certain embodiments, pharmaceutical compositions comprising an antisense compound targeted to PKK are used for the preparation of a medicament for treating a patient suffering or susceptible to an inflammatory disease or thromboembolic disease.

Certain Compositions

1. ISIS 546254

In certain embodiments, ISIS 546254 is characterized as a 5-10-5 MOE gapmer, having a sequence of (from 5' to 3') TGCAAGTCTCTTGGCAAACA (incorporated herein as SEQ ID NO: 570), wherein each internucleoside linkage is a phosphorothioate linkage, each cytosine is a 5'-methylcytosine, each of nucleosides 1-5 and 16-20 are 2'-O-methoxyethyl modified nucleosides, and each of nucleosides 6-15 are 2'-deoxynucleosides.

In certain embodiments, ISIS 546254 is described by the following chemical notation: Tes Ges mCes Aes Aes Gds Tds mCds Tds mCds Tds Tds Gds Gds mCds Aes Aes Aes mCes Ae; wherein, A=an adenine,
mC=a 5'-methylcytosine
G=a guanine,
T=a thymine,
e=a 2'-O-methoxyethyl modified nucleoside,
d=a 2'-deoxynucleoside, and
s=a phosphorothioate internucleoside linkage.

In certain embodiments, ISIS 546254 is described by the following chemical structure:

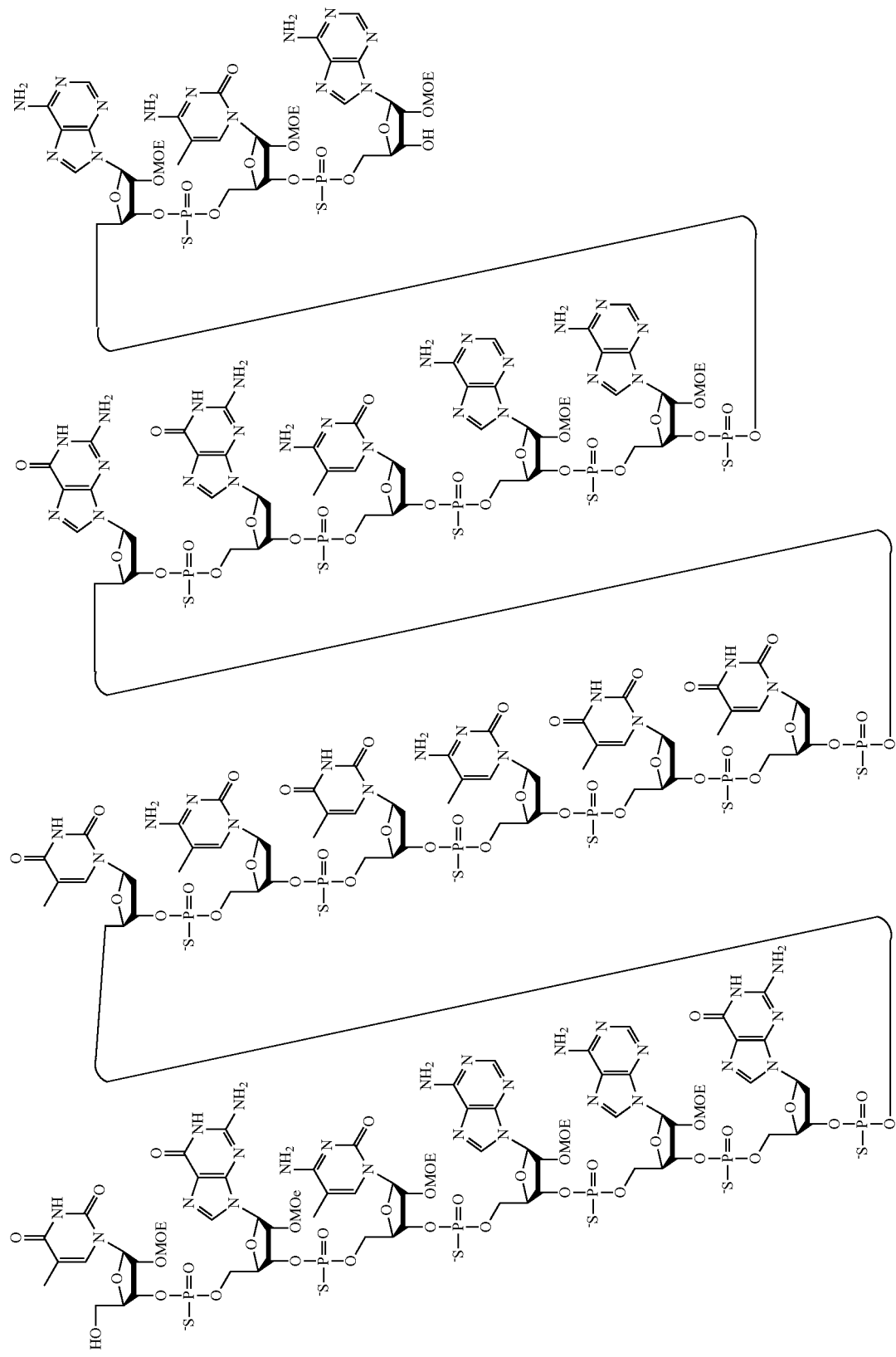

Structure 1. ISIS 546254

In certain embodiments, as provided in Example 2 (hereinbelow), ISIS 546254 achieved 95% inhibition of human PKK mRNA in cultured HepaRG™ cells (density of 20,000 cells per well) when transfected using electroporation with 5,000 nM antisense oligonucleotide after a treatment period of 24 hours and measured by quantitative real-time PCR using human primer probe set RTS3454 and adjusted according to total RNA content, as measured by RIBOGREEN®.

In certain embodiments, as provided in Example 5 (see Tables 34 and 41 hereinbelow), ISIS 546254 achieved an $IC_{50}$ of 0.2 µM and 0.3 µM in a 4 point dose response curve (0.19 µM, 0.56 µM, 1.67 µM, and 5.0 µM) in cultured HepaRG™ cells (density of 20,000 cells per well) when transfected using electroporation after a treatment period of 16 and measured by quantitative real-time PCR using human primer probe set RTS3454 and adjusted according to total RNA content, as measured by RIBOGREEN®.

In certain embodiments, as provided in Example 7 (hereinbelow), ISIS 546254 achieved 31%, 55%, 84%, and 83% human PKK mRNA inhibition and 0%, 36%, 51%, and 76% human PKK protein inhibition in transgenic mice harboring the human PKK gene sequence when injected subcutaneously twice a week for 3 weeks with 2.5 mg/kg/week, 5.0 mg/kg/week, 10 mg/kg/week or 20 mg/kg/week with ISIS 546254.

In certain embodiments, as provided in Example 8 (hereinbelow), ISISI 546254 is effective for inhibiting PKK mRNA and protein expression and is tolerable in primates.

2. ISIS 546343

In certain embodiments, ISIS 546343 is characterized as a 5-10-5 MOE gapmer, having a sequence of (from 5' to 3') CCCCCTTCTTTATAGCCAGC (incorporated herein as SEQ ID NO: 705), wherein each internucleoside linkage is a phosphorothioate linkage, each cytosine is a 5'-methylcytosine, each of nucleosides 1-5 and 16-20 are 2'-O-methoxyethyl modified nucleosides, and each of nucleosides 6-15 are 2'-deoxynucleosides.

In certain embodiments, ISIS 546343 is described by the following chemical notation: mCes mCes mCes mCes mCes Tds Tds mCds Tds Tds Tds Ads Tds Ads Gds mCes mCes Aes Ges mCe; wherein, A=an adenine,
mC=a 5'-methylcytosine;
G=a guanine,
T=a thymine,
e=a 2'-O-methoxyethyl modified nucleoside,
d=a 2'-deoxynucleoside, and
s=a phosphorothioate internucleoside linkage.

In certain embodiments, ISIS 546343 is described by the following chemical structure:

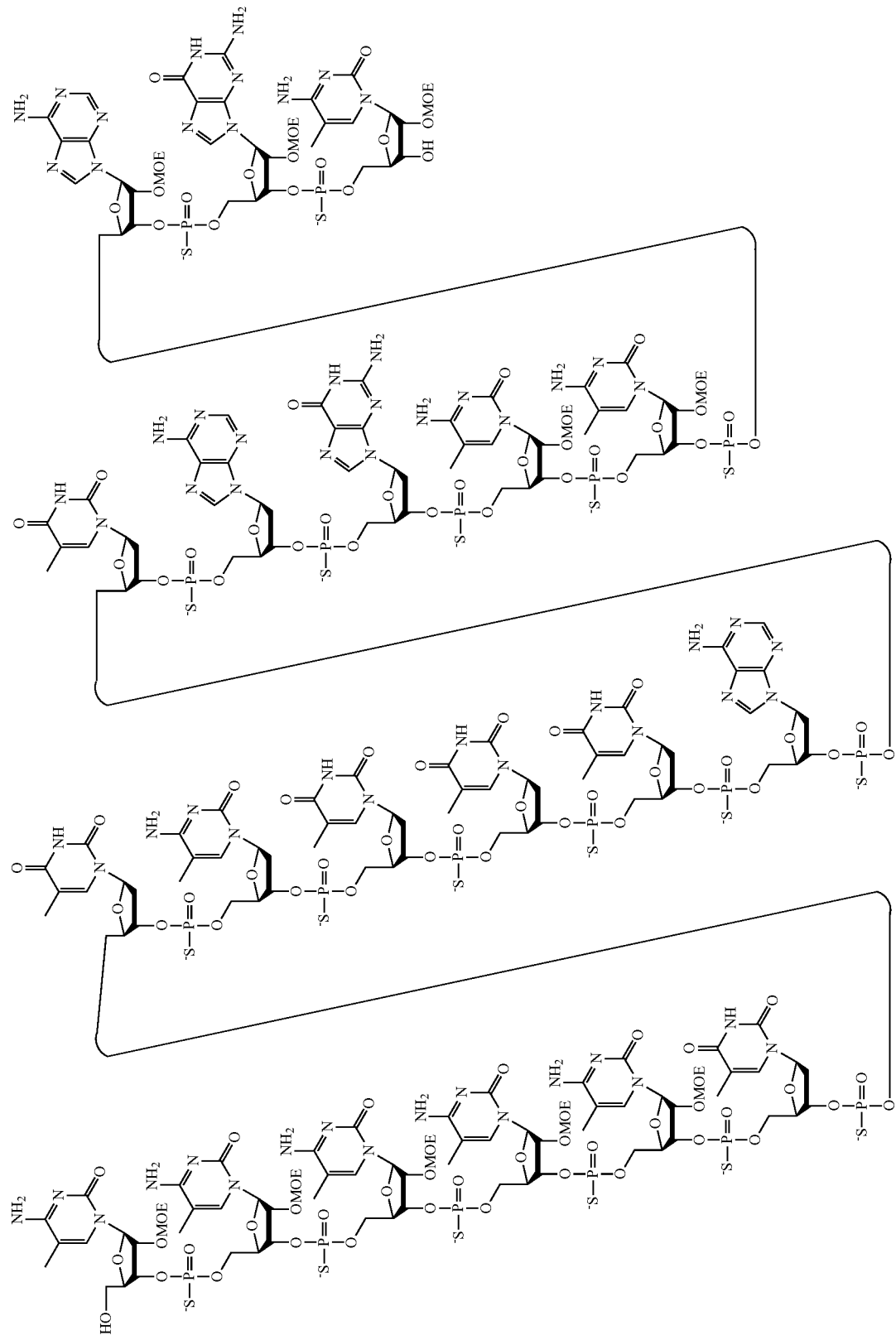

Structure 2. ISIS 546343

In certain embodiments, as provided in Example 2 (see Tables 9 and 10 hereinbelow), ISIS 546343 achieved 97% and 91% human PKK mRNA inhibition in cultured HepaRG™ cells (density of 20,000 cells per well) when transfected using electroporation with 5,000 nM antisense oligonucleotide after a treatment period of 24 hours and measured by quantitative real-time PCR using human primer probe set RTS3454 and adjusted according to total RNA content, as measured by RIBOGREEN®.

In certain embodiments, as provided twice in Example 5 (see Tables 34 and 41 hereinbelow), ISIS 546343 achieved an $IC_{50}$ of 0.4 µM in a 4 point dose response curve (0.19 µM, 0.56 µM, 1.67 µM, and 5.0 µM) in cultured HepaRG™ cells (density of 20,000 cells per well) when transfected using electroporation after a treatment period of 16 and measured by quantitative real-time PCR using human primer probe set RTS3454 and adjusted according to total RNA content, as measured by RIBOGREEN®.

In certain embodiments, as provided in Example 7 (hereinbelow), ISIS 546343 achieved 46%, 66%, and 86% human PKK mRNA inhibition and 0%, 38%, and 79% human PKK protein inhibition in transgenic mice harboring the human PKK gene sequence when injected subcutaneously twice a week for 3 weeks with 2.5 mg/kg/week, 5.0 mg/kg/week, 10 mg/kg/week or 20 mg/kg/week with ISIS 546343.

In certain embodiments, as provided in Example 8 (hereinbelow), ISISI 546343 is effective for inhibiting PKK mRNA and protein expression and is tolerable in primates.
3. ISIS 548048

In certain embodiments, ISIS 548048 is characterized as a modified antisense oligonucleotide having the nucleobase sequence (from 5' to 3') CGATATCATGATTCCC (incorporated herein as SEQ ID NO: 1666), consisting of a combination of sixteen 2'-deoxynucleosides, 2'-O-methoxyethyl modified nucleosides, and cEt modified nucleosides, wherein each of nucleosides 1, 2, and 16 are 2'-O-methoxyethyl modified nucleosides, wherein each of nucleosides 3, 14, and 15 are cEt modified nucleosides, wherein each of nucleosides 4-13 are 2'-deoxynucleosides, wherein each internucleoside linkage is a phosphorothioate internucleoside linkage, and wherein each cytosine is a 5'-methylcytosine.

In certain embodiments, ISIS 548048 is described by the following chemical notation: mCes Ges Aks Tds Ads Tds mCds Ads Tds Gds Ads Tds Tds mCks mCks mCe; wherein, A=an adenine,
mC=a 5'-methylcytosine;
G=a guanine,
T=a thymine,
e=a 2'-O-methoxyethyl modified nucleoside,
k=a cEt modified nucleoside,
d=a 2'-deoxynucleoside, and
s=a phosphorothioate internucleoside linkage.

In certain embodiments, ISIS 548048 is described by the following chemical structure:

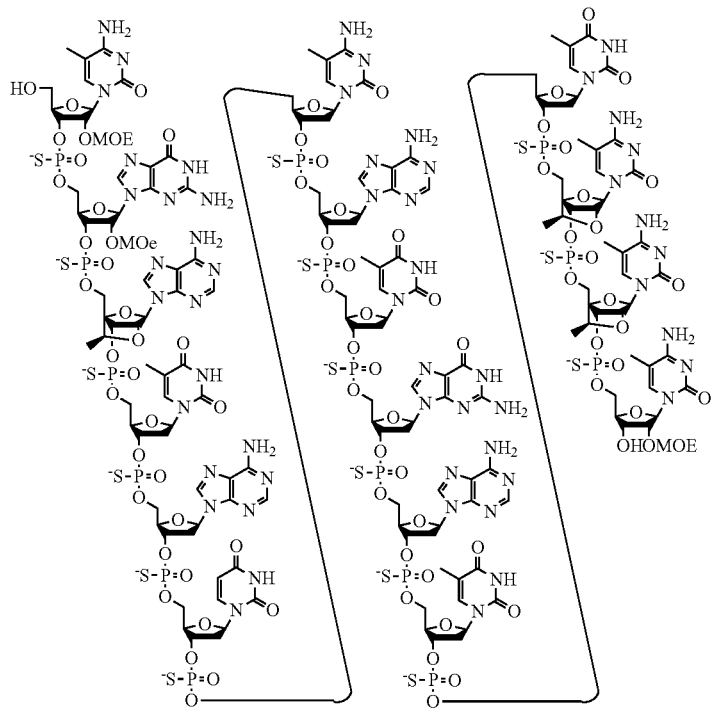

Structure 3. ISIS 548048

In certain embodiments, as provided in Example 3 (hereinbelow), ISIS 548048 achieved 84% mRNA inhibition in cultured HepaRG™ cells (density of 20,000 cells per well) when transfected using electroporation with 1,000 nM antisense oligonucleotide after a treatment period of 24 hours and measured by quantitative real-time PCR using human primer probe set RTS3454 and adjusted according to total RNA content, as measured by RIBOGREEN®.

In certain embodiments, as provided in Example 6 (hereinbelow), ISIS 548048 achieved an $IC_{50}$ of 0.1 µM in a 4 point dose response curve (0.11 µM, 0.33 µM, 1.00 µM, and 3.00 µM) in cultured HepaRG™ cells (density of 20,000 cells per well) when transfected using electroporation after a treatment period of 16 and measured by quantitative real-time PCR using human primer probe set RTS3454 and adjusted according to total RNA content, as measured by RIBOGREEN®.

In certain embodiments, as provided in Example 7 (hereinbelow), ISIS 548048 achieved 7%, 77%, 72% and 80% human PKK mRNA inhibition and 23%, 70%, 89%, and 98% human PKK protein inhibition in transgenic mice harboring the human PKK gene sequence when injected subcutaneously twice a week for 3 weeks with 2.5 mg/kg/week, 5.0 mg/kg/week, 10 mg/kg/week or 20 mg/kg/week with ISIS 548048.

In certain embodiments, as provided in Example 8 (hereinbelow), ISISI 548048 is effective for inhibiting PKK mRNA and protein expression and is tolerable in primates.

Certain Hotspot Regions

1. Nucleobases 27427-27466 of SEQ ID NO: 10

In certain embodiments, antisense oligonucleotides are designed to target nucleobases 27427-27466 of SEQ ID NO: 10 (GENBANK Accession No. NT_016354.19 truncated from nucleobases 111693001 to Ser. No. 11/730,000). In certain embodiments, nucleobases 27427-27466 of SEQ ID NO: 10 are a hotspot region. In certain embodiments, nucleobases 27427-27466 of SEQ ID NO: 10 are targeted by antisense oligonucleotides. In certain embodiments, the antisense oligonucleotides are 15, 16, 17, 18, 19, or 20 nucleobases in length. In certain embodiments, the antisense oligonucleotides are gapmers. In certain embodiments, the gapmers are 5-10-5 MOE gapmers, 4-9-4 MOE gapmers, 4-10-4 MOE gapmers, 4-10-3 MOE gapmers, 3-10-4 MOE gapmers, or 3-10-3 MOE gapmers. In certain embodiments, the gapmers are 5-10-5 MOE and cEt gapmers, 4-9-4 MOE and cEt gapmers, 4-10-4 MOE and cEt gapmers, 4-10-3 MOE and cEt gapmers, 3-10-4 MOE and cEt gapmers, or 3-10-3 MOE and cEt gapmers. In certain embodiments, the nucleosides of the antisense oligonucleotides are linked by phosphorothioate internucleoside linkages.

In certain embodiments, nucleobases 27427-27466 of SEQ ID NO: 10 are targeted by the following ISIS numbers: 530993, 530994, 530995, 546251, 546252, 546253, 546254, 546255, 546256, 547410, 547411, 547978, 547979, 547980, and 547981.

In certain embodiments, nucleobases 27427-27466 of SEQ ID NO: 10 are targeted by the following SEQ ID NOs: 94, 95, 96, 566, 567, 568, 569, 570, 571, 572, 573, 1597, 1598, 1599, and 1600.

In certain embodiments, antisense oligonucleotides targeting nucleobases 27427-27466 of SEQ ID NO: 10 achieve at least 30%, at least 31%, at least 32%, at least 33%, at least 34%, at least 35%, at least 36%, at least 37%, at least 38%, at least 39%, at least 40%, at least 41%, at least 42%, at least 43%, at least 44%, at least 45%, at least 46%, at least 47%, at least 48%, at least 49%, at least 50%, at least 51%, at least 52%, at least 53%, at least 54%, at least 55%, at least 56%, at least 57%, at least 58%, at least 59%, at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% reduction of PKK and/or protein levels in vitro and/or in vivo.

2. Nucleobases 33183-33242 of SEQ ID NO: 10

In certain embodiments, antisense oligonucleotides are designed to target nucleobases 33183-33242 of SEQ ID NO: 10 (GENBANK Accession No. NT_016354.19 truncated from nucleobases 111693001 to Ser. No. 11/730,000). In certain embodiments, nucleobases 33183-33242 of SEQ ID NO: 10 are a hotspot region. In certain embodiments, nucleobases 33183-33242 of SEQ ID NO: 10 are targeted by antisense oligonucleotides. In certain embodiments, the antisense oligonucleotides are 15, 16, 17, 18, 19, or 20 nucleobases in length. In certain embodiments, the antisense oligonucleotides are gapmers. In certain embodiments, the gapmers are 5-10-5 MOE gapmers, 4-9-4 MOE gapmers, 4-10-4 MOE gapmers, 4-10-3 MOE gapmers, 3-10-4 MOE gapmers, or 3-10-3 MOE gapmers. In certain embodiments, the gapmers are 5-10-5 MOE and cEt gapmers, 4-9-4 MOE and cEt gapmers, 4-10-4 MOE and cEt gapmers, 4-10-3 MOE and cEt gapmers, 3-10-4 MOE and cEt gapmers, or 3-10-3 MOE and cEt gapmers. In certain embodiments, the nucleosides of the antisense oligonucleotides are linked by phosphorothioate internucleoside linkages.

In certain embodiments, nucleobases 33183-33242 of SEQ ID NO: 10 are targeted by the following ISIS numbers: 531052, 531053, 531054, 531055, 531056, 531057, 531158, 546343, 546345, 547480, 547481, 547482, and 547483.

In certain embodiments, nucleobases 33183-33242 of SEQ ID NO: 10 are targeted by the following SEQ ID NOs: 155, 156, 157, 158, 159, 160, 261, 702, 703, 704, 705, 706, and 707.

In certain embodiments, antisense oligonucleotides targeting nucleobases 33183-33242 of SEQ ID NO: 10 achieve at least 30%, at least 31%, at least 32%, at least 33%, at least 34%, at least 35%, at least 36%, at least 37%, at least 38%, at least 39%, at least 40%, at least 41%, at least 42%, at least 43%, at least 44%, at least 45%, at least 46%, at least 47%, at least 48%, at least 49%, at least 50%, at least 51%, at least 52%, at least 53%, at least 54%, at least 55%, at least 56%, at least 57%, at least 58%, at least 59%, at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% reduction of PKK mRNA and/or protein levels in vitro and/or in vivo.

3. Nucleobases 30570-30610 of SEQ ID NO: 10

In certain embodiments, antisense oligonucleotides are designed to target nucleobases 30570-30610 of SEQ ID NO: 10 (GENBANK Accession No. NT_016354.19 truncated from nucleobases 111693001 to 11730000). In certain embodiments, nucleobases 30570-30610 of SEQ ID NO: 10 are a hotspot region. In certain embodiments, nucleobases 30570-30610 of SEQ ID NO: 10 are targeted by antisense oligonucleotides. In certain embodiments, the antisense oligonucleotides are 15, 16, 17, 18, 19, or 20 nucleobases in length. In certain embodiments, the antisense oligonucleotides are gapmers. In certain embodiments, the gapmers are 5-10-5 MOE gapmers, 4-9-4 MOE gapmers, 4-10-4 MOE gapmers, 4-10-3 MOE gapmers, 3-10-4 MOE gapmers, or 3-10-3 MOE gapmers. In certain embodiments, the gapmers are 5-10-5 MOE and cEt gapmers, 4-9-4 MOE and cEt gapmers, 4-10-4 MOE and cEt gapmers, 4-10-3 MOE and cEt gapmers, 3-10-4 MOE and cEt gapmers, or 3-10-3 MOE and cEt gapmers. In certain embodiments, the nucleosides of the antisense oligonucleotides are linked by phosphorothioate internucleoside linkages.

In certain embodiments, nucleobases 30570-30610 of SEQ ID NO: 10 are targeted by the following ISIS numbers: 531026, 546309, 546310, 546311, 546313, 547453, 547454, 547455, 547456, 547457, 547458, 548046, 548047, 548048, 548049, and 548050.

In certain embodiments, nucleobases 30570-30610 of SEQ ID NO: 10 are targeted by the following SEQ ID NOs: 129, 652, 653, 654, 655, 656, 657, 658, 659, 660, 661, 1664, 1665, 1666, 1667, and 1668.

In certain embodiments, antisense oligonucleotides targeting nucleobases 30570-30610 of SEQ ID NO: 10 achieve at least 30%, at least 31%, at least 32%, at least 33%, at least 34%, at least 35%, at least 36%, at least 37%, at least 38%, at least 39%, at least 40%, at least 41%, at least 42%, at least 43%, at least 44%, at least 45%, at least 46%, at least 47%, at least 48%, at least 49%, at least 50%, at least 51%, at least 52%, at least 53%, at least 54%, at least 55%, at least 56%, at least 57%, at least 58%, at least 59%, at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% reduction of PKK mRNA and/or protein levels in vitro and/or in vivo.

4. Nucleobases 27427-27520 of SEQ ID NO: 10

In certain embodiments, antisense oligonucleotides are designed to target nucleobases 27427-27520 of SEQ ID NO: 10 (GENBANK Accession No. NT_016354.19 truncated from nucleobases 111693001 to 11730000). In certain embodiments, nucleobases 27427-27520 of SEQ ID NO: 10 are a hotspot region. In certain embodiments, nucleobases 27427-27520 of SEQ ID NO: 10 are targeted by antisense oligonucleotides. In certain embodiments, the antisense oligonucleotides are 15, 16, 17, 18, 19, or 20 nucleobases in length. In certain embodiments, the antisense oligonucleotides are gapmers. In certain embodiments, the gapmers are 5-10-5 MOE gapmers, 4-9-4 MOE gapmers, 4-10-4 MOE gapmers, 4-10-3 MOE gapmers, 3-10-4 MOE gapmers, or 3-10-3 MOE gapmers. In certain embodiments, the gapmers are 5-10-5 MOE and cEt gapmers, 4-9-4 MOE and cEt gapmers, 4-10-4 MOE and cEt gapmers, 4-10-3 MOE and cEt gapmers, 3-10-4 MOE and cEt gapmers, or 3-10-3 MOE and cEt gapmers. In certain embodiments, the nucleosides of the antisense oligonucleotides are linked by phosphorothioate internucleoside linkages.

In certain embodiments, nucleobases 27427-27520 of SEQ ID NO: 10 are targeted by the following ISIS numbers: 530993-530999, 546251-546256, 546258-546260, 546263, 546265-546268, 547410-547417, and 547978-547992.

In certain embodiments, nucleobases 27427-27520 of SEQ ID NO: 10 are targeted by the following SEQ ID NOs: 94-100, 566-587, and 1597-1611.

In certain embodiments, antisense oligonucleotides targeting nucleobases 27427-27520 of SEQ ID NO: 10 achieve at least 30%, at least 31%, at least 32%, at least 33%, at least 34%, at least 35%, at least 36%, at least 37%, at least 38%, at least 39%, at least 40%, at least 41%, at least 42%, at least 43%, at least 44%, at least 45%, at least 46%, at least 47%, at least 48%, at least 49%, at least 50%, at least 51%, at least 52%, at least 53%, at least 54%, at least 55%, at least 56%, at least 57%, at least 58%, at least 59%, at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% reduction of PKK and/or protein levels in vitro and/or in vivo.

5. Nucleobases 33085-33247 of SEQ ID NO: 10

In certain embodiments, antisense oligonucleotides are designed to target nucleobases 33085-33247 of SEQ ID NO: 10 (GENBANK Accession No. NT_016354.19 truncated from nucleobases 111693001 to 11730000). In certain embodiments, nucleobases 33085-33247 of SEQ ID NO: 10 are a hotspot region. In certain embodiments, nucleobases 33085-33247 of SEQ ID NO: 10 are targeted by antisense oligonucleotides. In certain embodiments, the antisense oligonucleotides are 15, 16, 17, 18, 19, or 20 nucleobases in length. In certain embodiments, the antisense oligonucleotides are gapmers. In certain embodiments, the gapmers are 5-10-5 MOE gapmers, 4-9-4 MOE gapmers, 4-10-4 MOE gapmers, 4-10-3 MOE gapmers, 3-10-4 MOE gapmers, or 3-10-3 MOE gapmers. In certain embodiments, the gapmers are 5-10-5 MOE and cEt gapmers, 4-9-4 MOE and cEt gapmers, 4-10-4 MOE and cEt gapmers, 4-10-3 MOE and cEt gapmers, 3-10-4 MOE and cEt gapmers, or 3-10-3 MOE and cEt gapmers. In certain embodiments, the nucleosides of the antisense oligonucleotides are linked by phosphorothioate internucleoside linkages.

In certain embodiments, nucleobases 33085-33247 of SEQ ID NO: 10 are targeted by the following ISIS numbers: 531041-531158, 546336, 546339, 546340, 546343, 546345, 547474-547483, 547778, 548077-548082, and 548677-548678.

In certain embodiments, nucleobases 33085-33247 of SEQ ID NO: 10 are targeted by the following SEQ ID NOs: 144-160, 261, 693-707, 1256, 1320-1325, 2214, and 2215.

In certain embodiments, antisense oligonucleotides targeting nucleobases 33085-33247 of SEQ ID NO: 10 achieve at least 30%, at least 31%, at least 32%, at least 33%, at least 34%, at least 35%, at least 36%, at least 37%, at least 38%, at least 39%, at least 40%, at least 41%, at least 42%, at least 43%, at least 44%, at least 45%, at least 46%, at least 47%, at least 48%, at least 49%, at least 50%, at least 51%, at least 52%, at least 53%, at least 54%, at least 55%, at least 56%, at least 57%, at least 58%, at least 59%, at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% reduction of PKK and/or protein levels in vitro and/or in vivo.

6. Nucleobases 30475-30639 of SEQ ID NO: 10

In certain embodiments, antisense oligonucleotides are designed to target nucleobases 30475-30639 of SEQ ID NO: 10 (GENBANK Accession No. NT_016354.19 truncated from nucleobases 111693001 to 11730000). In certain embodiments, nucleobases 30475-30639 of SEQ ID NO: 10 are a hotspot region. In certain embodiments, nucleobases 30475-30639 of SEQ ID NO: 10 are targeted by antisense oligonucleotides. In certain embodiments, the antisense oligonucleotides are 15, 16, 17, 18, 19, or 20 nucleobases in length. In certain embodiments, the antisense oligonucleotides are gapmers. In certain embodiments, the gapmers are 5-10-5 MOE gapmers, 4-9-4 MOE gapmers, 4-10-4 MOE gapmers, 4-10-3 MOE gapmers, 3-10-4 MOE gapmers, or 3-10-3 MOE gapmers. In certain embodiments, the gapmers are 5-10-5 MOE and cEt gapmers, 4-9-4 MOE and cEt gapmers, 4-10-4 MOE and cEt gapmers, 4-10-3 MOE and cEt gapmers, 3-10-4 MOE and cEt gapmers, or 3-10-3 MOE and cEt gapmers. In certain embodiments, the nucleosides of the antisense oligonucleotides are linked by phosphorothioate internucleoside linkages.

In certain embodiments, nucleobases 30475-30639 of SEQ ID NO: 10 are targeted by the following ISIS numbers: 531021-531029, 531146, 546297, 546299-546304, 546306-546311, 546313, 546316-546319, 547444-547462, 548031, 548032, and 548034-548056.

In certain embodiments, nucleobases 30475-30639 of SEQ ID NO: 10 are targeted by the following SEQ ID NOs: 124-132, 249, 633-669, and 1650-1674.

In certain embodiments, antisense oligonucleotides targeting nucleobases 30475-30639 of SEQ ID NO: 10 achieve at least 30%, at least 31%, at least 32%, at least 33%, at least 34%, at least 35%, at least 36%, at least 37%, at least 38%, at least 39%, at least 40%, at least 41%, at least 42%, at least 43%, at least 44%, at least 45%, at least 46%, at least 47%, at least 48%, at least 49%, at least 50%, at least 51%, at least 52%, at least 53%, at least 54%, at least 55%, at least 56%, at least 57%, at least 58%, at least 59%, at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% reduction of PKK and/or protein levels in vitro and/or in vivo.

7. Nucleobases 27362-27524 of SEQ ID NO: 10

In certain embodiments, antisense oligonucleotides are designed to target nucleobases 27362-27524 of SEQ ID NO: 10 (GENBANK Accession No. NT_016354.19 truncated from nucleobases 111693001 to 11730000). In certain embodiments, nucleobases 27362-27524 correspond to exon 9 of PKK (GENBANK Accession No. NT_016354.19 truncated from nucleobases 111693001 to Ser. No. 11/730,000). In certain embodiments, nucleobases 27362-27524 of SEQ ID NO: 10 are a hotspot region. In certain embodiments, nucleobases 27362-27524 of SEQ ID NO: 10 are targeted by antisense oligonucleotides. In certain embodiments, the antisense oligonucleotides are 15, 16, 17, 18, 19, or 20 nucleobases in length. In certain embodiments, the antisense oligonucleotides are gapmers. In certain embodiments, the gapmers are 5-10-5 MOE gapmers, 4-9-4 MOE gapmers, 4-10-4 MOE gapmers, 4-10-3 MOE gapmers, 3-10-4 MOE gapmers, or 3-10-3 MOE gapmers. In certain embodiments, the gapmers are 5-10-5 MOE and cEt gapmers, 4-9-4 MOE and cEt gapmers, 4-10-4 MOE and cEt gapmers, 4-10-3 MOE and cEt gapmers, 3-10-4 MOE and cEt gapmers, or 3-10-3 MOE and cEt gapmers. In certain embodiments, the nucleosides of the antisense oligonucleotides are linked by phosphorothioate internucleoside linkages.

In certain embodiments, nucleobases 27361-27524 of SEQ ID NO: 10 are targeted by the following ISIS numbers: 530985-530999, 546244, 546247-546256, 546258-546260, 546263, 546265-546268, 547403-547417, 547723, 547968-547970, and 547972-547992.

In certain embodiments, nucleobases 27361-27524 of SEQ ID NO: 10 are targeted by the following SEQ ID NOs: 86-100, 554-587, 1217, and 1588-1611.

In certain embodiments, antisense oligonucleotides targeting nucleobases 27362-27524 of SEQ ID NO: 10 achieve at least 30%, at least 31%, at least 32%, at least 33%, at least 34%, at least 35%, at least 36%, at least 37%, at least 38%, at least 39%, at least 40%, at least 41%, at least 42%, at least 43%, at least 44%, at least 45%, at least 46%, at least 47%, at least 48%, at least 49%, at least 50%, at least 51%, at least 52%, at least 53%, at least 54%, at least 55%, at least 56%, at least 57%, at least 58%, at least 59%, at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% reduction of PKK and/or protein levels in vitro and/or in vivo.

8. Nucleobases 33101-33240 of SEQ ID NO: 10

In certain embodiments, antisense oligonucleotides are designed to target nucleobases 33101-33240 of SEQ ID NO: 10 (GENBANK Accession No. NT_016354.19 truncated from nucleobases 111693001 to 11730000). In certain embodiments, nucleobases 33101-33240 correspond to exon 14 of PKK (GENBANK Accession No. NT_016354.19 truncated from nucleobases 111693001 to Ser. No. 11/730,000). In certain embodiments, nucleobases 33101-33240 of SEQ ID NO: 10 are a hotspot region. In certain embodiments, nucleobases 33101-33240 of SEQ ID NO: 10 are targeted by antisense oligonucleotides. In certain embodiments, the antisense oligonucleotides are 15, 16, 17, 18, 19, or 20 nucleobases in length. In certain embodiments, the antisense oligonucleotides are gapmers. In certain embodiments, the gapmers are 5-10-5 MOE gapmers, 4-9-4 MOE gapmers, 4-10-4 MOE gapmers, 4-10-3 MOE gapmers, 3-10-4 MOE gapmers, or 3-10-3 MOE gapmers. In certain embodiments, the gapmers are 5-10-5 MOE and cEt gapmers, 4-9-4 MOE and cEt gapmers, 4-10-4 MOE and cEt gapmers, 4-10-3 MOE and cEt gapmers, 3-10-4 MOE and cEt gapmers, or 3-10-3 MOE and cEt gapmers. In certain embodiments, the nucleosides of the antisense oligonucleotides are linked by phosphorothioate internucleoside linkages.

In certain embodiments, nucleobases 33101-33240 of SEQ ID NO: 10 are targeted by the following ISIS numbers: 531041-531158, 546336, 546339, 546340, 546343, 546345, 547474-547483, 548077-548082, and 548678-548678.

In certain embodiments, nucleobases 33101-33240 of SEQ ID NO: 10 are targeted by the following SEQ ID NOs: 144-160, 261, 693-707, 1320-1325, and 2215.

In certain embodiments, antisense oligonucleotides targeting nucleobases 33101-33240 of SEQ ID NO: 10 achieve at least 30%, at least 31%, at least 32%, at least 33%, at least 34%, at least 35%, at least 36%, at least 37%, at least 38%, at least 39%, at least 40%, at least 41%, at least 42%, at least 43%, at least 44%, at least 45%, at least 46%, at least 47%, at least 48%, at least 49%, at least 50%, at least 51%, at least 52%, at least 53%, at least 54%, at least 55%, at least 56%, at least 57%, at least 58%, at least 59%, at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% reduction of PKK and/or protein levels in vitro and/or in vivo.

9. Nucleobases 30463-30638 of SEQ ID NO: 10

In certain embodiments, antisense oligonucleotides are designed to target nucleobases 30463-30638 of SEQ ID NO: 10 (GENBANK Accession No. NT_016354.19 truncated from nucleobases 111693001 to 11730000). In certain embodiments, nucleobases 30463-30638 correspond to exon 12 of PKK (GENBANK Accession No. NT_016354.19 truncated from nucleobases 111693001 to Ser. No. 11/730, 000). In certain embodiments, nucleobases 30463-30638 of SEQ ID NO: 10 are a hotspot region. In certain embodiments, nucleobases 30463-30638 of SEQ ID NO: 10 are targeted by antisense oligonucleotides. In certain embodiments, the antisense oligonucleotides are 15, 16, 17, 18, 19, or 20 nucleobases in length. In certain embodiments, the antisense oligonucleotides are gapmers. In certain embodiments, the gapmers are 5-10-5 MOE gapmers, 4-9-4 MOE gapmers, 4-10-4 MOE gapmers, 4-10-3 MOE gapmers, 3-10-4 MOE gapmers, or 3-10-3 MOE gapmers. In certain embodiments, the gapmers are 5-10-5 MOE and cEt gapmers, 4-9-4 MOE and cEt gapmers, 4-10-4 MOE and cEt gapmers, 4-10-3 MOE and cEt gapmers, 3-10-4 MOE and cEt gapmers, or 3-10-3 MOE and cEt gapmers. In certain embodiments, the nucleosides of the antisense oligonucleotides are linked by phosphorothioate internucleoside linkages.

In certain embodiments, nucleobases 30463-30638 of SEQ ID NO: 10 are targeted by the following ISIS numbers: 531021-531029, 531146, 546297, 546299-546304, 546306-546311, 546313, 546316-546319, 547444-547462, 548031, 548032, and 548034-548056.

In certain embodiments, nucleobases 30463-30638 of SEQ ID NO: 10 are targeted by the following SEQ ID NOs: 124-132, 249, 633-669, and 1650-1674.

In certain embodiments, antisense oligonucleotides targeting nucleobases 30463-30638 of SEQ ID NO: 10 achieve at least 30%, at least 31%, at least 32%, at least 33%, at least 34%, at least 35%, at least 36%, at least 37%, at least 38%, at least 39%, at least 40%, at least 41%, at least 42%, at least 43%, at least 44%, at least 45%, at least 46%, at least 47%, at least 48%, at least 49%, at least 50%, at least 51%, at least 52%, at least 53%, at least 54%, at least 55%, at least 56%, at least 57%, at least 58%, at least 59%, at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% reduction of PKK and/or protein levels in vitro and/or in vivo.

EXAMPLES

Non-Limiting Disclosure and Incorporation by Reference

While certain compounds, compositions and methods described herein have been described with specificity in accordance with certain embodiments, the following examples serve only to illustrate the compounds described herein and are not intended to limit the same. Each of the references recited in the present application is incorporated herein by reference in its entirety.

Example 1: Antisense Inhibition of Human PKK in HepaRG™$^T$ Cells by Antisense Oligonucleotides with 2'-MOE Sugar Modifications Antisense oligonucleotides were designed targeting a PKK nucleic acid and were tested for their effects on PKK mRNA in vitro. HepaRG™ cells, which are terminally differentiated hepatic cells derived from a human hepatic progenitor cell line and retain many characteristics of primary human hepatocytes (Lubberstedt M. et al., J. Pharmacol. Toxicol. Methods 2011 63: 59-68), were used in the screen.

The chimeric antisense oligonucleotides in the tables below were designed as 5-10-5 MOE gapmers. The gapmers are 20 nucleosides in length, wherein the central gap segment comprises of ten 2'-deoxynucleosides and is flanked by wing segments on the 5' direction and the 3' direction comprising five nucleosides each. Each nucleoside in the 5' wing segment and each nucleoside in the 3' wing segment has a 2'-O-methoxyethyl modification. The internucleoside linkages throughout each gapmer are phosphorothioate linkages. All cytosine residues throughout each gapmer are 5-methylcytosines. "Start site" indicates the 5'-most nucleoside to which the gapmer is targeted in the human gene sequence. "Stop site" indicates the 3'-most nucleoside to which the gapmer is targeted in the human gene sequence. Each gapmer listed in the tables below is targeted to either the human PKK mRNA, designated herein as SEQ ID NO: 1 (GENBANK Accession No. NM_000892.3) or the human PKK genomic sequence, designated herein as SEQ ID NO: 10 (GENBANK Accession No. NT_016354.19 truncated from nucleotides 111693001 to Ser. No. 11/730,000). 'n/a' indicates that the antisense oligonucleotide does not target that particular gene sequence.

Cultured HepaRG™ cells at a density of 20,000 cells per well were transfected using electroporation with 3,000 nM antisense oligonucleotide. After a treatment period of approximately 24 hours, RNA was isolated from the cells and PKK mRNA levels were measured by quantitative real-time PCR. Human primer probe set RTS3454 (forward sequence CCAAAAAAGGTGCACCAGTAACA, designated herein as SEQ ID NO: 20; reverse sequence CCTCCGGGACTGTACTTTAATAGG, designated herein as SEQ ID NO: 21; probe sequence CACGCAAACATTTCACAAGGCAGAGTACC, designated herein as SEQ ID NO: 22) was used to measure mRNA levels. PKK mRNA levels were adjusted according to total RNA content, as measured by RIBOGREEN®. The antisense oligonucleotides were tested in a series of experiments that had similar culture conditions. The results for each experiment are presented in separate tables shown below. Results are presented as percent inhibition of PKK, relative to untreated control cells.

TABLE 1

| ISIS NO | SEQ ID NO: 1 Start Site | SEQ ID NO: 1 Stop Site | Sequence | % inhibition | SEQ ID NO: 10 Start Site | SEQ ID NO: 10 Stop Site | SEQ ID NO |
|---|---|---|---|---|---|---|---|
| 530929 | 1 | 20 | AACGGTCTTCAAGCTGTTCT | 59 | 3393 | 3412 | 30 |
| 530930 | 6 | 25 | AAATGAACGGTCTTCAAGCT | 17 | 3398 | 3417 | 31 |
| 530931 | 11 | 30 | CTTAAAAATGAACGGTCTTC | 29 | 3403 | 3422 | 32 |
| 530932 | 16 | 35 | TGTCACTTAAAAATGAACGG | 52 | 3408 | 3427 | 33 |
| 530933 | 31 | 50 | TGGAGGTGAGTCTCTTGTCA | 76 | 3423 | 3442 | 34 |
| 530934 | 36 | 55 | CTTCTTGGAGGTGAGTCTCT | 54 | 3428 | 3447 | 35 |
| 530935 | 68 | 87 | GCTTGAATAAAATCATTCTG | 0 | n/a | n/a | 36 |
| 530936 | 73 | 92 | TGCTTGCTTGAATAAAATCA | 27 | 4072 | 4091 | 37 |
| 530937 | 78 | 97 | TAAGTTGCTTGCTTGAATAA | 0 | 4077 | 4096 | 38 |
| 530938 | 88 | 107 | GGAAATGAAATAAGTTGCTT | 11 | 4087 | 4106 | 39 |
| 530939 | 93 | 112 | AACAAGGAAATGAAATAAGT | 0 | 4092 | 4111 | 40 |
| 530940 | 98 | 117 | TAGCAAACAAGGAAATGAAA | 7 | 4097 | 4116 | 41 |
| 530941 | 103 | 122 | AACTGTAGCAAACAAGGAAA | 22 | 4102 | 4121 | 42 |
| 530942 | 108 | 127 | CAGGAAACTGTAGCAAACAA | 22 | 4107 | 4126 | 43 |
| 530943 | 113 | 132 | ATCCACAGGAAACTGTAGCA | 56 | n/a | n/a | 44 |
| 530944 | 118 | 137 | CAGACATCCACAGGAAACTG | 0 | n/a | n/a | 45 |
| 530945 | 157 | 176 | ATCCCCACCTCTGAAGAAGG | 0 | 8029 | 8048 | 46 |
| 530946 | 160 | 179 | TACATCCCCACCTCTGAAGA | 0 | 8032 | 8051 | 47 |
| 530947 | 165 | 184 | GAAGCTACATCCCCACCTCT | 27 | 8037 | 8056 | 48 |
| 530948 | 170 | 189 | ACATGGAAGCTACATCCCCA | 35 | 8042 | 8061 | 49 |
| 530949 | 175 | 194 | GGTGTACATGGAAGCTACAT | 31 | 8047 | 8066 | 50 |
| 530950 | 221 | 240 | ACCTTGGGTGGAATGTGCAC | 47 | 8093 | 8112 | 51 |
| 530951 | 226 | 245 | CAAACACCTTGGGTGGAATG | 49 | 8098 | 8117 | 52 |
| 530952 | 234 | 253 | CTGAATAGCAAACACCTTGG | 38 | 8106 | 8125 | 53 |
| 530953 | 239 | 258 | GAAAACTGAATAGCAAACAC | 7 | 8111 | 8130 | 54 |
| 530954 | 244 | 263 | TGGAAGAAAACTGAATAGCA | 47 | 8116 | 8135 | 55 |
| 530955 | 278 | 297 | CAAACCTTTTCTCCATGTCA | 55 | n/a | n/a | 56 |
| 530956 | 300 | 319 | ACACTATCTTTCAAGAAGCA | 57 | 9834 | 9853 | 57 |
| 530957 | 386 | 405 | GGCAAGCACTTATTTGATGA | 56 | n/a | n/a | 58 |
| 530958 | 432 | 451 | TTAAAATTGACTCCTCTCAT | 60 | 12688 | 12707 | 59 |
| 530959 | 456 | 475 | TCAACACTGCTAACCTTAGA | 60 | 12712 | 12731 | 60 |
| 530960 | 461 | 480 | ATTCTTCAACACTGCTAACC | 58 | 12717 | 12736 | 61 |
| 530961 | 466 | 485 | TTGGCATTCTTCAACACTGC | 88 | 12722 | 12741 | 62 |
| 530962 | 472 | 491 | CCTTTTTTGGCATTCTTCAA | 64 | 12728 | 12747 | 63 |
| 530963 | 479 | 498 | TGGTGCACCTTTTTTGGCAT | 78 | 12735 | 12754 | 64 |
| 530964 | 628 | 647 | CTTCAGTGAGAATCCAGATT | 44 | 14199 | 14218 | 65 |
| 530965 | 637 | 656 | GGCACAGGGCTTCAGTGAGA | 73 | 14208 | 14227 | 66 |

TABLE 1-continued

| ISIS NO | SEQ ID NO: 1 Start Site | SEQ ID NO: 1 Stop Site | Sequence | % inhibition | SEQ ID NO: 10 Start Site | SEQ ID NO: 10 Stop Site | SEQ ID NO |
|---|---|---|---|---|---|---|---|
| 530966 | 649 | 668 | AATTTCTGAAAGGGCACAGG | 58 | 14220 | 14239 | 67 |
| 530967 | 654 | 673 | CAACCAATTTCTGAAAGGGC | 69 | n/a | n/a | 68 |
| 530968 | 680 | 699 | CAAGATGCTGGAAGATGTTC | 18 | 26128 | 26147 | 69 |
| 530969 | 846 | 865 | GTGCCACTTTCAGATGTTTT | 0 | 27110 | 27129 | 70 |
| 530970 | 851 | 870 | TTGGTGTGCCACTTTCAGAT | 74 | 27115 | 27134 | 71 |
| 530971 | 856 | 875 | GGAACTTGGTGTGCCACTTT | 85 | 27120 | 27139 | 72 |
| 530972 | 861 | 880 | GTAGAGGAACTTGGTGTGCC | 42 | 27125 | 27144 | 73 |
| 530973 | 866 | 885 | GAGGAGTAGAGGAACTTGGT | 52 | 27130 | 27149 | 74 |
| 530974 | 871 | 890 | TTCTTGAGGAGTAGAGGAAC | 18 | 27135 | 27154 | 75 |
| 530975 | 876 | 895 | GTGTTTTCTTGAGGAGTAGA | 41 | 27140 | 27159 | 76 |
| 530976 | 881 | 900 | ATATGGTGTTTTCTTGAGGA | 26 | 27145 | 27164 | 77 |
| 530977 | 886 | 905 | TCCAGATATGGTGTTTTCTT | 55 | 27150 | 27169 | 78 |
| 530978 | 891 | 910 | CTATATCCAGATATGGTGTT | 0 | 27155 | 27174 | 79 |
| 530979 | 901 | 920 | GGTTAAAAGGCTATATCCAG | 35 | 27165 | 27184 | 80 |
| 530980 | 906 | 925 | TTGCAGGTTAAAAGGCTATA | 29 | 27170 | 27189 | 81 |
| 530981 | 911 | 930 | TTCTTTTGCAGGTTAAAAGG | 0 | 27175 | 27194 | 82 |
| 530982 | 916 | 935 | TAAAGTTCTTTTGCAGGTTA | 0 | 27180 | 27199 | 83 |
| 530983 | 931 | 950 | ATGGCAGGGTTCAGGTAAAG | 9 | n/a | n/a | 84 |
| 530984 | 936 | 955 | TTAGAATGGCAGGGTTCAGG | 25 | n/a | n/a | 85 |
| 530985 | 941 | 960 | AAATTTTAGAATGGCAGGGT | 32 | 27363 | 27382 | 86 |
| 530986 | 946 | 965 | CGGGTAAATTTTAGAATGGC | 62 | 27368 | 27387 | 87 |
| 530987 | 951 | 970 | ACTCCCGGGTAAATTTTAGA | 0 | 27373 | 27392 | 88 |
| 530988 | 961 | 980 | TCCAAAGTCAACTCCCGGGT | 76 | 27383 | 27402 | 89 |
| 530989 | 966 | 985 | TCTCCTCCAAAGTCAACTCC | 28 | 27388 | 27407 | 90 |
| 530990 | 971 | 990 | ATTCTTCTCCTCCAAAGTCA | 32 | 27393 | 27412 | 91 |
| 530991 | 976 | 995 | ATTCAATTCTTCTCCTCCAA | 43 | 27398 | 27417 | 92 |
| 530992 | 981 | 1000 | GTCACATTCAATTCTTCTCC | 70 | 27403 | 27422 | 93 |
| 530993 | 1005 | 1024 | CAAACATTCACTCCTTTAAC | 30 | 27427 | 27446 | 94 |
| 530994 | 1010 | 1029 | CTTGGCAAACATTCACTCCT | 50 | 27432 | 27451 | 95 |
| 530995 | 1015 | 1034 | AGTCTCTTGGCAAACATTCA | 49 | 27437 | 27456 | 96 |
| 530996 | 1038 | 1057 | TGACAGCGAATCATCTTTGT | 51 | 27460 | 27479 | 97 |
| 530997 | 1043 | 1062 | AAACTGACAGCGAATCATC | 39 | 27465 | 27484 | 98 |
| 530998 | 1048 | 1067 | AGTGAAAAACTGACAGCGAA | 0 | 27470 | 27489 | 99 |
| 530999 | 1071 | 1090 | CAGTCTTCTGGGAGTAAAGA | 31 | 27493 | 27512 | 100 |
| 531000 | 1098 | 1117 | AAGAAACACTTACACTTCTC | 1 | n/a | n/a | 101 |
| 531001 | 1108 | 1127 | AGATAATCTTAAGAAACACT | 44 | 27629 | 27648 | 102 |
| 531002 | 1155 | 1174 | GAGCTCCCTTGTGTCCCATA | 85 | 27676 | 27695 | 103 |

TABLE 1-continued

| ISIS NO | SEQ ID NO: 1 Start Site | SEQ ID NO: 1 Stop Site | Sequence | % inhibition | SEQ ID NO: 10 Start Site | SEQ ID NO: 10 Stop Site | SEQ ID NO |
|---|---|---|---|---|---|---|---|
| 531003 | 1160 | 1179 | AACCAGAGCTCCCTTGTGTC | 49 | 27681 | 27700 | 104 |
| 531004 | 1165 | 1184 | AGAGTAACCAGAGCTCCCTT | 76 | 27686 | 27705 | 105 |
| 531005 | 1170 | 1189 | CTCAAAGAGTAACCAGAGCT | 76 | 27691 | 27710 | 106 |
| 531006 | 1216 | 1235 | GCTTGTTTTGTTGTGCAGA | 49 | 27892 | 27911 | 107 |

TABLE 2

| ISIS NO | SEQ ID NO: 1 Start Site | SEQ ID NO: 1 Stop Site | Sequence | % inhibition | SEQ ID NO: 10 Start Site | SEQ ID NO: 10 Stop Site | SEQ ID NO |
|---|---|---|---|---|---|---|---|
| 482586 | 1608 | 1627 | ACCCAACAGTTGGTATAAAT | 0 | 31914 | 31933 | 108 |
| 486847 | 1563 | 1582 | AGGCATATTGGTTTTTGGAA | 78 | 31869 | 31888 | 109 |
| 531007 | 46 | 65 | AACACAATTGCTTCTTGGAG | 51 | 3438 | 3457 | 110 |
| 531008 | 675 | 694 | TGCTGGAAGATGTTCATGTG | 51 | 26123 | 26142 | 111 |
| 531009 | 1239 | 1258 | TTTGTTCCTCCAACAATGCG | 65 | 27915 | 27934 | 112 |
| 531010 | 1244 | 1263 | AAGAGTTTGTTCCTCCAACA | 52 | 27920 | 27939 | 113 |
| 531011 | 1249 | 1268 | CCAAGAAGAGTTTGTTCCTC | 0 | 27925 | 27944 | 114 |
| 531012 | 1254 | 1273 | TCTCCCCAAGAAGAGTTTGT | 48 | 27930 | 27949 | 115 |
| 531013 | 1264 | 1283 | CCAGGGCCACTCTCCCCAAG | 56 | 27940 | 27959 | 116 |
| 531014 | 1287 | 1306 | AGCTTCACCTGCAGGCTCAC | 0 | 27963 | 27982 | 117 |
| 531015 | 1324 | 1343 | TATGAGTGACCCTCCACACA | 52 | 28000 | 28019 | 118 |
| 531016 | 1329 | 1348 | TGTCCTATGAGTGACCCTCC | 39 | 28005 | 28024 | 119 |
| 531017 | 1334 | 1353 | ACTGGTGTCCTATGAGTGAC | 31 | 28010 | 28029 | 120 |
| 531018 | 1339 | 1358 | GACCCACTGGTGTCCTATGA | 54 | 28015 | 28034 | 121 |
| 531019 | 1344 | 1363 | GTGAGGACCCACTGGTGTCC | 28 | 28020 | 28039 | 122 |
| 531020 | 1369 | 1388 | AAGCCCATCAAAGCAGTGGG | 0 | n/a | n/a | 123 |
| 531021 | 1420 | 1439 | GTCTGACAGATTTAAAATGC | 50 | 30498 | 30517 | 124 |
| 531022 | 1425 | 1444 | GTAATGTCTGACAGATTTAA | 74 | 30503 | 30522 | 125 |
| 531023 | 1430 | 1449 | CTTTTGTAATGTCTGACAGA | 71 | 30508 | 30527 | 126 |
| 531024 | 1452 | 1471 | TTTATTTGTGAGAAAGGTGT | 69 | 30530 | 30549 | 127 |
| 531025 | 1457 | 1476 | TCTCTTTTATTTGTGAGAAA | 34 | 30535 | 30554 | 128 |
| 531026 | 1501 | 1520 | ATCATGATTCCCTTCTGAGA | 73 | 30579 | 30598 | 129 |
| 531027 | 1530 | 1549 | AAAGGAGCCTGGAGTTTTAT | 0 | 30608 | 30627 | 130 |
| 531028 | 1535 | 1554 | AATTCAAAGGAGCCTGGAGT | 56 | 30613 | 30632 | 131 |
| 531029 | 1540 | 1559 | AGTGTAATTCAAAGGAGCCT | 59 | 30618 | 30637 | 132 |
| 531030 | 1545 | 1564 | AATTCAGTGTAATTCAAAGG | 24 | n/a | n/a | 133 |
| 531031 | 1550 | 1569 | TTTGGAATTCAGTGTAATTC | 59 | n/a | n/a | 134 |
| 531032 | 1555 | 1574 | TGGTTTTTGGAATTCAGTGT | 67 | n/a | n/a | 135 |

TABLE 2-continued

| ISIS NO | SEQ ID NO: 1 Start Site | SEQ ID NO: 1 Stop Site | Sequence | % inhibition | SEQ ID NO: 10 Start Site | SEQ ID NO: 10 Stop Site | SEQ ID NO |
|---|---|---|---|---|---|---|---|
| 531033 | 1557 | 1576 | ATTGGTTTTTGGAATTCAGT | 53 | n/a | n/a | 136 |
| 531034 | 1560 | 1579 | CATATTGGTTTTTGGAATTC | 36 | 31866 | 31885 | 137 |
| 531035 | 1565 | 1584 | GTAGGCATATTGGTTTTTGG | 46 | 31871 | 31890 | 138 |
| 531036 | 1581 | 1600 | GTGTCACCTTTGGAAGGTAG | 71 | 31887 | 31906 | 139 |
| 531037 | 1604 | 1623 | AACAGTTGGTATAAATTGTG | 35 | 31910 | 31929 | 140 |
| 531038 | 1605 | 1624 | CAACAGTTGGTATAAATTGT | 22 | 31911 | 31930 | 141 |
| 531039 | 1609 | 1628 | TACCCAACAGTTGGTATAAA | 36 | 31915 | 31934 | 142 |
| 531040 | 1632 | 1651 | TCCTTCGAGAAGCCCCATCC | 27 | 31938 | 31957 | 143 |
| 531041 | 1677 | 1696 | AAAGGAATATTTACCTTTTG | 68 | 33121 | 33140 | 144 |
| 531042 | 1682 | 1701 | TTACCAAAGGAATATTTACC | 11 | 33126 | 33145 | 145 |
| 531043 | 1687 | 1706 | ATTTGTTACCAAAGGAATAT | 27 | 33131 | 33150 | 146 |
| 531044 | 1697 | 1716 | GGCATTCTTCATTTGTTACC | 68 | 33141 | 33160 | 147 |
| 531045 | 1702 | 1721 | TTTCTGGCATTCTTCATTTG | 37 | 33146 | 33165 | 148 |
| 531046 | 1709 | 1728 | GATATCTTTTCTGGCATTCT | 54 | 33153 | 33172 | 149 |
| 531047 | 1714 | 1733 | ATCTTGATATCTTTTCTGGC | 68 | 33158 | 33177 | 150 |
| 531048 | 1719 | 1738 | TTATAATCTTGATATCTTTT | 42 | 33163 | 33182 | 151 |
| 531049 | 1724 | 1743 | TTATTTTATAATCTTGATAT | 2 | 33168 | 33187 | 152 |
| 531050 | 1729 | 1748 | TTGGGTTATTTTATAATCTT | 18 | 33173 | 33192 | 153 |
| 531051 | 1734 | 1753 | ATCCGTTGGGTTATTTTATA | 51 | 33178 | 33197 | 154 |
| 531052 | 1739 | 1758 | AGACCATCCGTTGGGTTATT | 60 | 33183 | 33202 | 155 |
| 531053 | 1744 | 1763 | AGCACAGACCATCCGTTGGG | 49 | 33188 | 33207 | 156 |
| 531054 | 1754 | 1773 | CTTTATAGCCAGCACAGACC | 48 | 33198 | 33217 | 157 |
| 531055 | 1759 | 1778 | CCCTTCTTTATAGCCAGCAC | 68 | 33203 | 33222 | 158 |
| 531056 | 1764 | 1783 | TTTCCCCCTTCTTTATAGCC | 45 | 33208 | 33227 | 159 |
| 531057 | 1769 | 1788 | CATCTTTTCCCCCTTCTTTA | 48 | 33213 | 33232 | 160 |
| 531058 | 1779 | 1798 | CCCTTACAAGCATCTTTTCC | 60 | n/a | n/a | 161 |
| 531059 | n/a | n/a | ACATTCCATTGTGTTTGCAA | 55 | 33919 | 33938 | 162 |
| 531060 | n/a | n/a | TGGTGATGCCCACCAAACGC | 35 | 33940 | 33959 | 163 |
| 531061 | 1872 | 1891 | TGCTCCCTGCGGGCACAGCC | 52 | 33971 | 33990 | 164 |
| 531062 | 1877 | 1896 | CAGGTTGCTCCCTGCGGGCA | 39 | 33976 | 33995 | 165 |
| 531063 | 1882 | 1901 | GACACCAGGTTGCTCCCTGC | 51 | 33981 | 34000 | 166 |
| 531064 | 1887 | 1906 | GTGTAGACACCAGGTTGCTC | 56 | 33986 | 34005 | 167 |
| 531065 | 1892 | 1911 | CTTTGGTGTAGACACCAGGT | 57 | 33991 | 34010 | 168 |
| 531066 | 1897 | 1916 | AGCGACTTTGGTGTAGACAC | 67 | 33996 | 34015 | 169 |
| 531067 | 1902 | 1921 | TACTCAGCGACTTTGGTGTA | 31 | 34001 | 34020 | 170 |
| 531068 | 1907 | 1926 | CCATGTACTCAGCGACTTTG | 59 | 34006 | 34025 | 171 |
| 531069 | 1912 | 1931 | CCAGTCCATGTACTCAGCGA | 56 | 34011 | 34030 | 172 |

TABLE 2-continued

| ISIS NO | SEQ ID NO: 1 Start Site | SEQ ID NO: 1 Stop Site | Sequence | % inhibition | SEQ ID NO: 10 Start Site | SEQ ID NO: 10 Stop Site | SEQ ID NO |
|---|---|---|---|---|---|---|---|
| 531070 | 1930 | 1949 | CTGTGTTTTCTCTAAAATCC | 68 | 34029 | 34048 | 173 |
| 531071 | 1935 | 1954 | CTGCTCTGTGTTTTCTCTAA | 73 | 34034 | 34053 | 174 |
| 531072 | 2026 | 2045 | GCTCAGAATTTGACTTGAAC | 64 | 34125 | 34144 | 175 |
| 531073 | 2031 | 2050 | CCCAGGCTCAGAATTTGACT | 51 | 34130 | 34149 | 176 |
| 531074 | 2049 | 2068 | CTTTGCAGATGAGGACCCCC | 67 | 34148 | 34167 | 177 |
| 531075 | 2054 | 2073 | CCATGCTTTGCAGATGAGGA | 64 | 34153 | 34172 | 178 |
| 531076 | 2059 | 2078 | ACTCTCCATGCTTTGCAGAT | 68 | 34158 | 34177 | 179 |
| 531077 | 2064 | 2083 | ATGCCACTCTCCATGCTTTG | 51 | 34163 | 34182 | 180 |
| 531078 | 2111 | 2130 | AGCAGCTCTGAGTGCACTGT | 77 | 34210 | 34229 | 181 |
| 531079 | 2116 | 2135 | TCCTCAGCAGCTCTGAGTGC | 58 | 34215 | 34234 | 182 |
| 531080 | 2121 | 2140 | CATTGTCCTCAGCAGCTCTG | 55 | 34220 | 34239 | 183 |
| 531081 | n/a | n/a | TGGTTTTTGGAATTCTGAAA | 14 | 31861 | 31880 | 184 |
| 531082 | n/a | n/a | ATATTGGTTTTTGGAATTCT | 31 | 31865 | 31884 | 185 |

TABLE 3

| ISIS NO | SEQ ID NO: 1 Start Site | SEQ ID NO: 1 Stop Site | Sequence | % inhibition | SEQ ID NO: 10 Start Site | SEQ ID NO: 10 Stop Site | SEQ ID NO |
|---|---|---|---|---|---|---|---|
| 531083 | n/a | n/a | TGTACTAGTTTCCTATAACT | 60 | 14738 14809 14880 14939 15071 15214 15286 15345 15477 15549 15607 15679 15809 15881 15939 | 14757 14828 14899 14958 15090 15233 15305 15364 15496 15568 15626 15698 15828 15900 15958 | 186 |
| 531084 | n/a | n/a | ATAGGGACACAACCAAGGAA | 25 | 16296 | 16315 | 187 |
| 531085 | n/a | n/a | AGGCACAGAGCCAGCACCCA | 9 | 16495 | 16514 | 188 |
| 531086 | n/a | n/a | CCTGCCTCCTGGCAGCCTTC | 48 | 16696 | 16715 | 189 |
| 531087 | n/a | n/a | CCAGGTGTGGACAGCAGCTG | 52 | 16821 | 16840 | 190 |
| 531088 | n/a | n/a | GGTTTTGTTTGTAAAATTAG | 27 | 17159 | 17178 | 191 |
| 531089 | n/a | n/a | AAAACACCATTAAATCCATT | 45 | 17306 | 17325 | 192 |
| 531090 | n/a | n/a | ACAGAAACCATGATGTTGCT | 59 | 17644 | 17663 | 193 |
| 531091 | n/a | n/a | TCAGCCCAATGTCCTAACCT | 35 | 17793 | 17812 | 194 |
| 531092 | n/a | n/a | CCTTCACTGACTCTCTTTTC | 24 | 17922 | 17941 | 195 |
| 531093 | n/a | n/a | TTCTCCTGGCTCAGAAGCTC | 60 | 18053 23315 | 18072 23334 | 196 |

TABLE 3-continued

| ISIS NO | SEQ ID NO: 1 Start Site | SEQ ID NO: 1 Stop Site | Sequence | % inhibition | SEQ ID NO: 10 Start Site | SEQ ID NO: 10 Stop Site | SEQ ID NO |
|---|---|---|---|---|---|---|---|
| 531094 | n/a | n/a | GAATGTCAGGCCTCTGGGCC | 48 | 18181 | 18200 | 197 |
| 531095 | n/a | n/a | CTAACAACCCCACAATATCA | 20 | 18390 | 18409 | 198 |
| 531096 | n/a | n/a | CCCAATTCTTAGTCCTTTAA | 45 | 18523 | 18542 | 199 |
| 531097 | n/a | n/a | ACCAAGCTCAGCCTCCAACT | 41 | 18648 | 18667 | 200 |
| 531098 | n/a | n/a | TTATTAGTCAAATCACCCAA | 19 | 18773 | 18792 | 201 |
| 531099 | n/a | n/a | TGGATGGGTAGAGGCCTTTC | 64 | 18898 | 18917 | 202 |
| 531100 | n/a | n/a | CCCCCTCCCTTCCCTACACA | 0 | 19023 | 19042 | 203 |
| 531101 | n/a | n/a | ATGTAAGTTACAAGCCACTA | 37 | 19153 | 19172 | 204 |
| 531102 | n/a | n/a | TGCCTCTTTAATAAAAACTC | 42 | 19484 | 19503 | 205 |
| 531103 | n/a | n/a | ACTCATTGCCTTAACTCAGG | 40 | 19636 | 19655 | 206 |
| 531104 | n/a | n/a | ACTTGACCTTACTGTTTTAG | 20 | 19886 | 19905 | 207 |
| 531105 | n/a | n/a | CTCCTCCCCAGGCTGCTCCT | 16 | 22092 | 22111 | 208 |
| 531106 | n/a | n/a | AAGATCTAGATAATTCTTGT | 31 | 22332 | 22351 | 209 |
| 531107 | n/a | n/a | TCAACTCACACCTGACCTAA | 30 | 22457 | 22476 | 210 |
| 531108 | n/a | n/a | TGAACCCAAAACTCTGGCAC | 50 | 22771 | 22790 | 211 |
| 531109 | n/a | n/a | AGCCCAAGGAACATCTCACC | 52 | 22959 | 22978 | 212 |
| 531110 | n/a | n/a | GCCTGTTTGGTGGTCTCTTC | 86 | 23110 | 23129 | 213 |
| 531111 | n/a | n/a | CTTCTCCTGGCTCAGAAGCT | 68 | 18054 23316 | 18073 23335 | 214 |
| 531112 | n/a | n/a | ATGTATGATTCTAAGAACTT | 14 | 23479 | 23498 | 215 |
| 531113 | n/a | n/a | AACAGACACATTATTTATAT | 0 | 23604 | 23623 | 216 |
| 531114 | n/a | n/a | AGAGTCAAGTCCACAGACAT | 40 | 24246 | 24265 | 217 |
| 531115 | n/a | n/a | TCCTAAATAGGAACAAAGTA | 0 | 24372 | 24391 | 218 |
| 531116 | n/a | n/a | TTGTTAAGGTTGTAGAGAGA | 23 | 24688 | 24707 | 219 |
| 531117 | n/a | n/a | ACCCAATTATTTTTAATGGC | 62 | 24876 | 24895 | 220 |
| 531118 | n/a | n/a | GCCTAAATGTAAGAGCTAAA | 26 | 25157 | 25176 | 221 |
| 531119 | n/a | n/a | TAAACTCTTACATTTATAGA | 0 | 25293 | 25312 | 222 |
| 531120 | n/a | n/a | AAATAAAAGCACTCAGACTG | 0 | 25418 | 25437 | 223 |
| 531121 | n/a | n/a | TTGGTCTACAGATTCAATGC | 72 | 25550 | 25569 | 224 |
| 531122 | n/a | n/a | TAACAAAAATGCCTTGTGCC | 33 | 25710 | 25729 | 225 |
| 531123 | n/a | n/a | TCCCAGCTCCAGTCACCACC | 74 | 25866 | 25885 | 226 |
| 531124 | n/a | n/a | GTACTAAACATCCTAAGTGA | 2 | 25992 | 26011 | 227 |
| 531125 | n/a | n/a | ACTCGCCTTTGTGACTCGAT | 23 | 26264 | 26283 | 228 |

TABLE 3-continued

| ISIS NO | SEQ ID NO: 1 Start Site | SEQ ID NO: 1 Stop Site | Sequence | % inhibition | SEQ ID NO: 10 Start Site | SEQ ID NO: 10 Stop Site | SEQ ID NO |
|---|---|---|---|---|---|---|---|
| 531126 | n/a | n/a | TTTTGAATCTTCATTCAAAG | 0 | 26551 | 26570 | 229 |
| 531127 | n/a | n/a | CAGAGCCTTGATCAGAATAA | 12 | 26676 | 26695 | 230 |
| 531128 | n/a | n/a | AAGTTCCACCTTCTAACTGG | 18 | 26831 | 26850 | 231 |
| 531129 | n/a | n/a | AGCAGCTCACACCCAAAAAG | 0 | 27005 | 27024 | 232 |
| 531130 | n/a | n/a | TTCTGTGTCAATTATAAACA | 0 | 27344 | 27363 | 233 |
| 531131 | n/a | n/a | TAGAAAGAGTAAGCCTTCAC | 0 | 27587 | 27606 | 234 |
| 531132 | n/a | n/a | AGTGAGGTTACTCACCAGAG | 0 | 27732 | 27751 | 235 |
| 531133 | n/a | n/a | TTTTGTTGTGCAGACTGAAA | 19 | 27886 | 27905 | 236 |
| 531134 | n/a | n/a | TTACCCATCAAAGCAGTGGG | 6 | 28045 | 28064 | 237 |
| 531135 | n/a | n/a | AATGTTGTGAATACCATCCC | 16 | 28174 | 28193 | 238 |
| 531136 | n/a | n/a | TAACATTTCTATGGGCCTGA | 6 | 28670 | 28689 | 239 |
| 531137 | n/a | n/a | TGTCTACTATTTGACCAATA | 19 | 28795 | 28814 | 240 |
| 531138 | n/a | n/a | TTTAAATGTGTCACTTAATC | 0 | 28987 | 29006 | 241 |
| 531139 | n/a | n/a | TCACTAAAACAAAAATACTT | 0 | 29156 | 29175 | 242 |
| 531140 | n/a | n/a | TCTTCCAGGCCAACCACCTT | 22 | 29321 | 29340 | 243 |
| 531141 | n/a | n/a | TGCAAGGCATGTGTGCACAA | 47 | 29532 | 29551 | 244 |
| 531142 | n/a | n/a | TGTTTAAAATATCTCTATAC | 8 | 30008 | 30027 | 245 |
| 531143 | n/a | n/a | CATGGAAAAATTAAGCTCAT | 0 | 30133 | 30152 | 246 |
| 531144 | n/a | n/a | TGAAGATTCTATTTAACAAA | 0 | 30266 | 30285 | 247 |
| 531145 | n/a | n/a | GCCTAGGAGAGAAAAATAAA | 0 | 30445 | 30464 | 248 |
| 531146 | n/a | n/a | CCAGTGTAATTCAAAGGAGC | 40 | 30620 | 30639 | 249 |
| 531147 | n/a | n/a | CCATTATTTCCATCACCTGC | 18 | 30871 | 30890 | 250 |
| 531148 | n/a | n/a | TACCCAAATTATACCTGGAA | 8 | 31015 | 31034 | 251 |
| 531149 | n/a | n/a | AGAGGTAAAGCAACTTGCCC | 45 | 31429 | 31448 | 252 |
| 531150 | n/a | n/a | TCCTTAATAGTCATAGCAGG | 48 | 31558 | 31577 | 253 |
| 531151 | n/a | n/a | TCACCACCATTTTTCACATG | 44 | 31683 | 31702 | 254 |
| 531152 | n/a | n/a | GTTATGGATATAGACTTTAA | 0 | 31808 | 31827 | 255 |
| 531153 | n/a | n/a | CTAGAAGCAATATTTAAAGC | 0 | 31974 | 31993 | 256 |
| 531154 | n/a | n/a | ATGAAGTAAGATGCTTAAAA | 16 | 32162 | 32181 | 257 |
| 531155 | n/a | n/a | CTTCTTGTCTCAGATTACCA | 79 | 32464 | 32483 | 258 |
| 531156 | n/a | n/a | TCTGAAAAGCCCTCCGAGCT | 0 | 32589 | 32608 | 259 |
| 531157 | n/a | n/a | AAGTGAATCAGAGCAGTGTA | 46 | 32961 | 32980 | 260 |
| 531158 | n/a | n/a | ACCTTACAAGCATCTTTTCC | 41 | 33223 | 33242 | 261 |
| 531159 | n/a | n/a | ATTTGTTAAAAGTTGCTTAT | 0 | 33368 | 33387 | 262 |
| 531160 | n/a | n/a | TGATATCATCATCCCAATGA | 13 | 33510 | 33529 | 263 |

TABLE 4

| ISIS NO | SEQ ID NO: 1 Start Site | SEQ ID NO: 1 Stop Site | Sequence | % inhibition | SEQ ID NO: 10 Start Site | SEQ ID NO: 10 Stop Site | SEQ ID NO |
|---|---|---|---|---|---|---|---|
| 531083 | n/a | n/a | TGTACTAGTTTCCTATAACT | 68 | 14738 | 14757 | 264 |
|  |  |  |  |  | 14809 | 14828 |  |
|  |  |  |  |  | 14880 | 14899 |  |
|  |  |  |  |  | 14939 | 14958 |  |
|  |  |  |  |  | 15071 | 15090 |  |
|  |  |  |  |  | 15214 | 15233 |  |
|  |  |  |  |  | 15286 | 15305 |  |
|  |  |  |  |  | 15345 | 15364 |  |
|  |  |  |  |  | 15477 | 15496 |  |
|  |  |  |  |  | 15549 | 15568 |  |
|  |  |  |  |  | 15607 | 15626 |  |
|  |  |  |  |  | 15679 | 15698 |  |
|  |  |  |  |  | 15809 | 15828 |  |
|  |  |  |  |  | 15881 | 15900 |  |
|  |  |  |  |  | 15939 | 15958 |  |
| 531161 | n/a | n/a | CAGACACCTTCTTCACAAGG | 40 | 898 | 917 | 264 |
| 531162 | n/a | n/a | AATTTCCCAGATGTATTAGT | 43 | 1054 | 1073 | 265 |
| 531163 | n/a | n/a | TCAGCAGAAATCATGTAGGC | 60 | 1181 | 1200 | 266 |
| 531164 | n/a | n/a | TTAAATATAAAGAGATCCTC | 38 | 1609 | 1628 | 267 |
| 531165 | n/a | n/a | GTAATAAAAGGAATGATAAA | 0 | 1825 | 1844 | 268 |
| 531166 | n/a | n/a | AGACAGTAAACAAAATCAGG | 12 | 2046 | 2065 | 269 |
| 531167 | n/a | n/a | CAAGAAACCACCAAAGGAAG | 37 | 2176 | 2195 | 270 |
| 531168 | n/a | n/a | ACCCCAACAGACAGCCCACC | 55 | 2314 | 2333 | 271 |
| 531169 | n/a | n/a | TGGGCTCACCCCAGTGGACC | 54 | 2580 | 2599 | 272 |
| 531170 | n/a | n/a | GCCTGGCCCCAAGACTCTA | 54 | 2743 | 2762 | 273 |
| 531171 | n/a | n/a | AGGCCTGCCACAGGCCAGAC | 40 | 2873 | 2892 | 274 |
| 531172 | n/a | n/a | TTCAAGCCTGGGCAGCACAG | 71 | 3004 | 3023 | 275 |
| 531173 | n/a | n/a | AAAATAACTTCACTAGAGCT | 22 | 3131 | 3150 | 276 |
| 531174 | n/a | n/a | TGTTAAGTATATTAACTATT | 10 | 3256 | 3275 | 277 |
| 531175 | n/a | n/a | TACTCAGGAAATTAGAATAT | 25 | 3550 | 3569 | 278 |
| 531176 | n/a | n/a | TTATGAAACCTCTTGATTTG | 0 | 3753 | 3772 | 279 |
| 531177 | n/a | n/a | TTCTTGTAAATGTCTGAATT | 61 | 3971 | 3990 | 280 |
| 531178 | n/a | n/a | ACCACAGGAAACTGTAGCAA | 72 | 4111 | 4130 | 281 |
| 531179 | n/a | n/a | GATTGGACCCAGACACTATA | 57 | 4506 | 4525 | 282 |
| 531180 | n/a | n/a | CCTCTTAAGTCACCATAGAC | 45 | 4785 | 4804 | 283 |
| 531181 | n/a | n/a | GGTTGAGGGACAGACACAGG | 36 | 4940 | 4959 | 284 |
| 531182 | n/a | n/a | ATAATCATGATTTATTTTGC | 34 | 5099 | 5118 | 285 |
| 531183 | n/a | n/a | CATAAGAATGTGCACACAAA | 39 | 5382 | 5401 | 286 |
| 531184 | n/a | n/a | ACTCTTATTAGCTGGTAGAA | 74 | 5538 | 5557 | 287 |
| 531185 | n/a | n/a | GGACCAAAACTGAGAGGCAG | 63 | 5663 | 5682 | 288 |
| 531186 | n/a | n/a | CCATTACTCTCAAGCTCCAC | 75 | 5890 | 5909 | 289 |
| 531187 | n/a | n/a | ATCTATTGGTTCAGGAGCCA | 72 | 6015 | 6034 | 290 |
| 531188 | n/a | n/a | GTTAAAACAACTAGAAGCCA | 67 | 6146 | 6165 | 291 |
| 531189 | n/a | n/a | AGGTGTTCTTGCTTATCCTC | 63 | 6484 | 6503 | 292 |

TABLE 4-continued

| ISIS NO | SEQ ID NO: 1 Start Site | SEQ ID NO: 1 Stop Site | Sequence | % inhibition | SEQ ID NO: 10 Start Site | SEQ ID NO: 10 Stop Site | SEQ ID NO |
|---|---|---|---|---|---|---|---|
| 531190 | n/a | n/a | GCAGTCACTCCTCTTCCAGC | 59 | 6659 | 6678 | 293 |
| 531191 | n/a | n/a | AAGTGTATTGCCTAGATTTC | 37 | 6784 | 6803 | 294 |
| 531192 | n/a | n/a | GAGTGCCATCTTCTCTGCAC | 61 | 6968 | 6987 | 295 |
| 531193 | n/a | n/a | TTATTCCCAGCTCTAAAATA | 23 | 7274 | 7293 | 296 |
| 531194 | n/a | n/a | CTCACAATTCTGTAAGGGAA | 64 | 7596 | 7615 | 297 |
| 531195 | n/a | n/a | ATAAAATATATTAAGGCAAC | 61 | 7846 | 7865 | 298 |
| 531196 | n/a | n/a | TTGAGTCAGACATCCTGTGA | 38 | 7996 | 8015 | 299 |
| 531197 | n/a | n/a | TACCTTTTCTCCATGTCATT | 42 | 8148 | 8167 | 300 |
| 531198 | n/a | n/a | GGGATTTTGCTGAAGCTGGT | 73 | 8273 | 8292 | 301 |
| 531199 | n/a | n/a | CTTTGAATAGAAAATGACTA | 1 | 8415 | 8434 | 302 |
| 531200 | n/a | n/a | CAAAATCACAAGTTCTAGAT | 51 | 8617 | 8636 | 303 |
| 531201 | n/a | n/a | TTTCCAATACTTTTACAAAT | 52 | 8760 | 8779 | 304 |
| 531202 | n/a | n/a | ATTAATAAGCATCTCTCTGA | 31 | 9109 | 9128 | 305 |
| 531203 | n/a | n/a | TGACTATCCAATTTCTAGTT | 67 | 9253 | 9272 | 306 |
| 531204 | n/a | n/a | CTTGTAGTCTGCACTTAATG | 60 | 9418 | 9437 | 307 |
| 531205 | n/a | n/a | ACATTTTTTAAGTACAGGAA | 0 | 9602 | 9621 | 308 |
| 531206 | n/a | n/a | GAAATGTCTAGCATTTTCTA | 28 | 9755 | 9774 | 309 |
| 531207 | n/a | n/a | CCACTTATTTGATGACCACA | 64 | 9915 | 9934 | 310 |
| 531208 | n/a | n/a | TCCAGAATACTGCCCCATCT | 23 | 10050 | 10069 | 311 |
| 531209 | n/a | n/a | TGGATTCATTTTCTGCAAAT | 81 | 10175 | 10194 | 312 |
| 531210 | n/a | n/a | AGACATTGTCAAATGTCCCC | 60 | 10322 | 10341 | 313 |
| 531211 | n/a | n/a | TTGATGTCAGCACTGTTGAC | 77 | 10480 | 10499 | 314 |
| 531212 | n/a | n/a | ACATCAGTAGCTTCAGATGT | 56 | 10618 | 10637 | 315 |
| 531213 | n/a | n/a | CAAAATTAATTGTGCATAAT | 13 | 10820 | 10839 | 316 |
| 531214 | n/a | n/a | TTTTTCTTTAAATTTTGCTA | 37 | 11120 | 11139 | 317 |
| 531215 | n/a | n/a | TAGAGATTTATGTACTTGG | 63 | 11245 | 11264 | 318 |
| 531216 | n/a | n/a | AAACACAGGAATTTGCAGAC | 33 | 11408 | 11427 | 319 |
| 531217 | n/a | n/a | GTGGAATAAACCATAATCTA | 47 | 11579 | 11598 | 320 |
| 531218 | n/a | n/a | GATAATTCTTTTCACAGACA | 72 | 12028 | 12047 | 321 |
| 531219 | n/a | n/a | CTTCTCTATCTCCCAGTGTT | 61 | 12227 | 12246 | 322 |
| 531220 | n/a | n/a | CAATACAGGTAAATTTCACG | 56 | 12374 | 12393 | 323 |
| 531221 | n/a | n/a | AAGGGATTTAAAATTTTTAT | 0 | 12507 | 12526 | 324 |
| 531222 | n/a | n/a | GGCAAGCTGTACAAGAAAAA | 19 | 12642 | 12661 | 325 |
| 531223 | n/a | n/a | TGTACTCACCGGTACTCTGC | 58 | 12805 | 12824 | 326 |
| 531224 | n/a | n/a | AAGAGAATGCTCAGAAATGG | 25 | 13435 | 13454 | 327 |
| 531225 | n/a | n/a | ACACTTGTACCCCATACATC | 45 | 13560 | 13579 | 328 |
| 531226 | n/a | n/a | GACAGTAGAGACTGGGAAGG | 12 | 13708 | 13727 | 329 |

TABLE 4-continued

| ISIS NO | SEQ ID NO: 1 Start Site | SEQ ID NO: 1 Stop Site | Sequence | % inhibition | SEQ ID NO: 10 Start Site | SEQ ID NO: 10 Stop Site | SEQ ID NO |
|---|---|---|---|---|---|---|---|
| 531227 | n/a | n/a | TACCAATTTCTGAAAGGGCA | 72 | 14224 | 14243 | 330 |
| 531228 | n/a | n/a | CAGAGTAAACTCCCCATCTC | 33 | 14387 | 14406 | 331 |
| 531229 | n/a | n/a | CTTCAAAGCCAGCAGTGTAA | 69 | 14514 | 14533 | 332 |
| 531230 | n/a | n/a | CTTACTGGGCTAAAATCAAG | 46 | 14639 | 14658 | 333 |
| 531231 | n/a | n/a | TATCACTGTACTAGTTTCCT | 94 | 14744 | 14763 | 334 |
|  |  |  |  |  | 14815 | 14834 |  |
|  |  |  |  |  | 14886 | 14905 |  |
|  |  |  |  |  | 14945 | 14964 |  |
|  |  |  |  |  | 15005 | 15024 |  |
|  |  |  |  |  | 15077 | 15096 |  |
|  |  |  |  |  | 15220 | 15239 |  |
|  |  |  |  |  | 15292 | 15311 |  |
|  |  |  |  |  | 15351 | 15370 |  |
|  |  |  |  |  | 15411 | 15430 |  |
|  |  |  |  |  | 15483 | 15502 |  |
|  |  |  |  |  | 15555 | 15574 |  |
|  |  |  |  |  | 15613 | 15632 |  |
|  |  |  |  |  | 15685 | 15704 |  |
|  |  |  |  |  | 15815 | 15834 |  |
|  |  |  |  |  | 15887 | 15906 |  |
|  |  |  |  |  | 15945 | 15964 |  |
| 531232 | n/a | n/a | CTGTACTAGTTTCCTATAAC | 85 | 14739 | 14758 | 335 |
|  |  |  |  |  | 14810 | 14829 |  |
|  |  |  |  |  | 14881 | 14900 |  |
|  |  |  |  |  | 14940 | 14959 |  |
|  |  |  |  |  | 15000 | 15019 |  |
|  |  |  |  |  | 15072 | 15091 |  |
|  |  |  |  |  | 15215 | 15234 |  |
|  |  |  |  |  | 15287 | 15306 |  |
|  |  |  |  |  | 15346 | 15365 |  |
|  |  |  |  |  | 15406 | 15425 |  |
|  |  |  |  |  | 15478 | 15497 |  |
|  |  |  |  |  | 15550 | 15569 |  |
|  |  |  |  |  | 15608 | 15627 |  |
|  |  |  |  |  | 15680 | 15699 |  |
|  |  |  |  |  | 15810 | 15829 |  |
|  |  |  |  |  | 15882 | 15901 |  |
|  |  |  |  |  | 15940 | 15959 |  |
| 531233 | n/a | n/a | ACTGTACTAGTTTCCTATAA | 86 | 14740 | 14759 | 336 |
|  |  |  |  |  | 14811 | 14830 |  |
|  |  |  |  |  | 14882 | 14901 |  |
|  |  |  |  |  | 14941 | 14960 |  |
|  |  |  |  |  | 15001 | 15020 |  |
|  |  |  |  |  | 15073 | 15092 |  |
|  |  |  |  |  | 15216 | 15235 |  |
|  |  |  |  |  | 15288 | 15307 |  |
|  |  |  |  |  | 15347 | 15366 |  |
|  |  |  |  |  | 15407 | 15426 |  |
|  |  |  |  |  | 15479 | 15498 |  |
|  |  |  |  |  | 15551 | 15570 |  |
|  |  |  |  |  | 15609 | 15628 |  |
|  |  |  |  |  | 15681 | 15700 |  |
|  |  |  |  |  | 15811 | 15830 |  |
|  |  |  |  |  | 15883 | 15902 |  |
|  |  |  |  |  | 15941 | 15960 |  |
| 531234 | n/a | n/a | CACTGTACTAGTTTCCTATA | 86 | 14741 | 14760 | 337 |
|  |  |  |  |  | 14812 | 14831 |  |
|  |  |  |  |  | 14883 | 14902 |  |
|  |  |  |  |  | 14942 | 14961 |  |
|  |  |  |  |  | 15002 | 15021 |  |
|  |  |  |  |  | 15074 | 15093 |  |
|  |  |  |  |  | 15217 | 15236 |  |
|  |  |  |  |  | 15289 | 15308 |  |
|  |  |  |  |  | 15348 | 15367 |  |
|  |  |  |  |  | 15408 | 15427 |  |
|  |  |  |  |  | 15480 | 15499 |  |
|  |  |  |  |  | 15552 | 15571 |  |

TABLE 4-continued

| ISIS NO | SEQ ID NO: 1 Start Site | SEQ ID NO: 1 Stop Site | Sequence | % inhibition | SEQ ID NO: 10 Start Site | SEQ ID NO: 10 Stop Site | SEQ ID NO |
|---|---|---|---|---|---|---|---|
| | | | | | 15610 | 15629 | |
| | | | | | 15682 | 15701 | |
| | | | | | 15812 | 15831 | |
| | | | | | 15884 | 15903 | |
| | | | | | 15942 | 15961 | |
| 531235 | n/a | n/a | TCACTGTACTAGTTTCCTAT | 86 | 14742 | 14761 | 338 |
| | | | | | 14813 | 14832 | |
| | | | | | 14884 | 14903 | |
| | | | | | 14943 | 14962 | |
| | | | | | 15003 | 15022 | |
| | | | | | 15075 | 15094 | |
| | | | | | 15218 | 15237 | |
| | | | | | 15290 | 15309 | |
| | | | | | 15349 | 15368 | |
| | | | | | 15409 | 15428 | |
| | | | | | 15481 | 15500 | |
| | | | | | 15553 | 15572 | |
| | | | | | 15611 | 15630 | |
| | | | | | 15683 | 15702 | |
| | | | | | 15813 | 15832 | |
| | | | | | 15885 | 15904 | |
| | | | | | 15943 | 15962 | |
| 531236 | n/a | n/a | ATCACTGTACTAGTTTCCTA | 87 | 14743 | 14762 | 339 |
| | | | | | 14814 | 14833 | |
| | | | | | 14885 | 14904 | |
| | | | | | 14944 | 14963 | |
| | | | | | 15004 | 15023 | |
| | | | | | 15076 | 15095 | |
| | | | | | 15219 | 15238 | |
| | | | | | 15291 | 15310 | |
| | | | | | 15350 | 15369 | |
| | | | | | 15410 | 15429 | |
| | | | | | 15482 | 15501 | |
| | | | | | 15554 | 15573 | |
| | | | | | 15612 | 15631 | |
| | | | | | 15684 | 15703 | |
| | | | | | 15814 | 15833 | |
| | | | | | 15886 | 15905 | |
| | | | | | 15944 | 15963 | |
| 531237 | n/a | n/a | GTGGAATGTCATGGCAATTT | 56 | 16399 | 16418 | 340 |

Example 2: Antisense Inhibition of Human PKK in HepaRG™ Cells by Antisense Oligonucleotides with 2'-MOE Sugar Modifications Additional antisense oligonucleotides were designed targeting a PKK nucleic acid and were tested for their effects on PKK mRNA in vitro.

The chimeric antisense oligonucleotides in the tables below were designed as 5-10-5 MOE gapmers, 4-9-4 MOE gapmers, 4-10-4 MOE gapmers, 4-10-3 MOE gapmers, 3-10-4 MOE gapmers, or 3-10-3 MOE gapmers. The 5-10-5 MOE gapmers are 20 nucleosides in length, wherein the central gap segment comprises of ten 2'-deoxynucleosides and is flanked by wing segments on the 5' direction and the 3' direction comprising five nucleosides each. The 4-9-4 MOE gapmers are 17 nucleosides in length, wherein the central gap segment comprises of nine 2'-deoxynucleosides and is flanked by wing segments on the 5' direction and the 3' direction comprising four nucleosides each. The 4-10-4 MOE gapmers are 18 nucleosides in length, wherein the central gap segment comprises of ten 2'-deoxynucleosides and is flanked by wing segments on the 5' direction and the 3' direction comprising four nucleosides each. The 4-10-3 MOE gapmers are 17 nucleosides in length, wherein the central gap segment comprises of ten 2'-deoxynucleosides and is flanked by wing segments on the 5' direction and the 3' direction comprising four and three nucleosides respectively. The 3-10-4 MOE gapmers are 17 nucleosides in length, wherein the central gap segment comprises of ten 2'-deoxynucleosides and is flanked by wing segments on the 5' direction and the 3' direction comprising three and four nucleosides respectively. The 3-10-3 MOE gapmers are 16 nucleosides in length, wherein the central gap segment comprises of ten 2'-deoxynucleosides and is flanked by wing segments on the 5' direction and the 3' direction comprising three nucleosides each. Each nucleoside in the 5' wing segment and each nucleoside in the 3' wing segment has a 2'-O-methoxyethyl modification. The internucleoside linkages throughout each gapmer are phosphorothioate linkages. All cytosine residues throughout each gapmer are 5-methylcytosines. "Start site" indicates the 5'-most nucleoside to which the gapmer is targeted in the human gene sequence. "Stop site" indicates the 3'-most nucleoside to which the gapmer is targeted in the human gene sequence. Each gapmer listed in the tables below is targeted to either SEQ ID NO: 1 or SEQ ID NO: 10. 'n/a' indicates that the antisense oligonucleotide does not target that particular gene sequence.

Cultured HepaRG™ cells at a density of 20,000 cells per well were transfected using electroporation with 5,000 nM antisense oligonucleotide. After a treatment period of approximately 24 hours, RNA was isolated from the cells and PKK mRNA levels were measured by quantitative real-time PCR. Human primer probe set RTS3454 was used to measure mRNA levels. PKK mRNA levels were adjusted according to total RNA content, as measured by RIBOGREEN®. The antisense oligonucleotides were tested in a series of experiments that had similar culture conditions. The results for each experiment are presented in separate tables shown below. Results are presented as percent inhibition of PKK, relative to untreated control cells.

TABLE 5

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 531231 | n/a | n/a | TATCACTGTACTAGTTTCCT | 5-10-5 | 98 | 14744 | 14763 | 334 |
| | | | | | | 14815 | 14834 | |
| | | | | | | 14886 | 14905 | |
| | | | | | | 14945 | 14964 | |
| | | | | | | 15005 | 15024 | |
| | | | | | | 15077 | 15096 | |
| | | | | | | 15220 | 15239 | |
| | | | | | | 15292 | 15311 | |
| | | | | | | 15351 | 15370 | |
| | | | | | | 15411 | 15430 | |
| | | | | | | 15483 | 15502 | |
| | | | | | | 15555 | 15574 | |
| | | | | | | 15613 | 15632 | |
| | | | | | | 15685 | 15704 | |
| | | | | | | 15815 | 15834 | |
| | | | | | | 15887 | 15906 | |
| | | | | | | 15945 | 15964 | |
| 546131 | 4 | 23 | ATGAACGGTCTTCAAGCTGT | 5-10-5 | 75 | 3396 | 3415 | 341 |
| 547269 | 5 | 24 | AATGAACGGTCTTCAAGCTG | 5-10-5 | 56 | 3397 | 3416 | 342 |
| 547270 | 7 | 26 | AAAATGAACGGTCTTCAAGC | 5-10-5 | 68 | 3399 | 3418 | 343 |
| 547271 | 10 | 29 | TTAAAAATGAACGGTCTTCA | 5-10-5 | 60 | 3402 | 3421 | 344 |
| 547272 | 13 | 32 | CACTTAAAAATGAACGGTCT | 5-10-5 | 82 | 3405 | 3424 | 345 |
| 547273 | 25 | 44 | TGAGTCTCTTGTCACTTAAA | 5-10-5 | 93 | 3417 | 3436 | 346 |
| 547274 | 29 | 48 | GAGGTGAGTCTCTTGTCACT | 5-10-5 | 70 | 3421 | 3440 | 347 |
| 546136 | 30 | 49 | GGAGGTGAGTCTCTTGTCAC | 5-10-5 | 86 | 3422 | 3441 | 348 |
| 547275 | 32 | 51 | TTGGAGGTGAGTCTCTTGTC | 5-10-5 | 87 | 3424 | 3443 | 349 |
| 546137 | 40 | 59 | ATTGCTTCTTGGAGGTGAGT | 5-10-5 | 76 | 3432 | 3451 | 350 |
| 547276 | 42 | 61 | CAATTGCTTCTTGGAGGTGA | 5-10-5 | 93 | 3434 | 3453 | 351 |
| 547277 | 44 | 63 | CACAATTGCTTCTTGGAGGT | 5-10-5 | 75 | 3436 | 3455 | 352 |
| 547278 | 45 | 64 | ACACAATTGCTTCTTGGAGG | 5-10-5 | 70 | 3437 | 3456 | 353 |
| 546138 | 47 | 66 | AAACACAATTGCTTCTTGGA | 5-10-5 | 69 | 3439 | 3458 | 354 |
| 547279 | 48 | 67 | AAAACACAATTGCTTCTTGG | 5-10-5 | 69 | 3440 | 3459 | 355 |
| 547280 | 49 | 68 | GAAAACACAATTGCTTCTTG | 5-10-5 | 47 | 3441 | 3460 | 356 |
| 547281 | 70 | 89 | TTGCTTGAATAAAATCATTC | 5-10-5 | 41 | 4069 | 4088 | 357 |
| 546140 | 72 | 91 | GCTTGCTTGAATAAAATCAT | 5-10-5 | 60 | 4071 | 4090 | 358 |
| 547282 | 74 | 93 | TTGCTTGCTTGAATAAAATC | 5-10-5 | 53 | 4073 | 4092 | 359 |
| 547283 | 76 | 95 | AGTTGCTTGCTTGAATAAAA | 5-10-5 | 67 | 4075 | 4094 | 360 |
| 546141 | 82 | 101 | GAAATAAGTTGCTTGCTTGA | 5-10-5 | 56 | 4081 | 4100 | 361 |
| 547284 | 86 | 105 | AAATGAAATAAGTTGCTTGC | 5-10-5 | 26 | 4085 | 4104 | 362 |

TABLE 5-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 547285 | 102 | 121 | ACTGTAGCAAACAAGGAAAT | 5-10-5 | 51 | 4101 | 4120 | 363 |
| 546143 | 106 | 125 | GGAAACTGTAGCAAACAAGG | 5-10-5 | 46 | 4105 | 4124 | 364 |
| 546144 | 110 | 129 | CACAGGAAACTGTAGCAAAC | 5-10-5 | 75 | 4109 | 4128 | 365 |
| 547286 | 117 | 136 | AGACATCCACAGGAAACTGT | 5-10-5 | 68 | n/a | n/a | 366 |
| 547287 | 120 | 139 | GTCAGACATCCACAGGAAAC | 5-10-5 | 69 | n/a | n/a | 367 |
| 546146 | 123 | 142 | TGAGTCAGACATCCACAGGA | 5-10-5 | 72 | n/a | n/a | 368 |
| 547288 | 131 | 150 | CATAGAGTTGAGTCAGACAT | 5-10-5 | 80 | 8003 | 8022 | 369 |
| 546147 | 132 | 151 | TCATAGAGTTGAGTCAGACA | 5-10-5 | 76 | 8004 | 8023 | 370 |
| 547289 | 133 | 152 | TTCATAGAGTTGAGTCAGAC | 5-10-5 | 74 | 8005 | 8024 | 371 |
| 546148 | 137 | 156 | CGTTTTCATAGAGTTGAGTC | 5-10-5 | 68 | 8009 | 8028 | 372 |
| 546149 | 155 | 174 | CCCCACCTCTGAAGAAGGCG | 5-10-5 | 83 | 8027 | 8046 | 373 |
| 546150 | 158 | 177 | CATCCCCACCTCTGAAGAAG | 5-10-5 | 58 | 8030 | 8049 | 374 |
| 547290 | 163 | 182 | AGCTACATCCCCACCTCTGA | 5-10-5 | 76 | 8035 | 8054 | 375 |
| 546151 | 166 | 185 | GGAAGCTACATCCCCACCTC | 5-10-5 | 76 | 8038 | 8057 | 376 |
| 547291 | 168 | 187 | ATGGAAGCTACATCCCCACC | 5-10-5 | 74 | 8040 | 8059 | 377 |
| 547292 | 171 | 190 | TACATGGAAGCTACATCCCC | 5-10-5 | 60 | 8043 | 8062 | 378 |
| 546152 | 172 | 191 | GTACATGGAAGCTACATCCC | 5-10-5 | 73 | 8044 | 8063 | 379 |
| 546153 | 176 | 195 | GGGTGTACATGGAAGCTACA | 5-10-5 | 76 | 8048 | 8067 | 380 |
| 546154 | 195 | 214 | TGGCAGTATTGGGCATTTGG | 5-10-5 | 85 | 8067 | 8086 | 381 |
| 547293 | 199 | 218 | CATCTGGCAGTATTGGGCAT | 5-10-5 | 92 | 8071 | 8090 | 382 |
| 547294 | 201 | 220 | CTCATCTGGCAGTATTGGGC | 5-10-5 | 85 | 8073 | 8092 | 383 |
| 546155 | 202 | 221 | CCTCATCTGGCAGTATTGGG | 5-10-5 | 47 | 8074 | 8093 | 384 |
| 547295 | 203 | 222 | ACCTCATCTGGCAGTATTGG | 5-10-5 | 88 | 8075 | 8094 | 385 |
| 547296 | 206 | 225 | TGCACCTCATCTGGCAGTAT | 5-10-5 | 72 | 8078 | 8097 | 386 |
| 546156 | 211 | 230 | GAATGTGCACCTCATCTGGC | 5-10-5 | 81 | 8083 | 8102 | 387 |
| 547297 | 213 | 232 | TGGAATGTGCACCTCATCTG | 5-10-5 | 84 | 8085 | 8104 | 388 |
| 546157 | 216 | 235 | GGGTGGAATGTGCACCTCAT | 5-10-5 | 85 | 8088 | 8107 | 389 |
| 547298 | 218 | 237 | TTGGGTGGAATGTGCACCTC | 5-10-5 | 90 | 8090 | 8109 | 390 |
| 546158 | 219 | 238 | CTTGGGTGGAATGTGCACCT | 5-10-5 | 95 | 8091 | 8110 | 391 |
| 546159 | 229 | 248 | TAGCAAACACCTTGGGTGGA | 5-10-5 | 76 | 8101 | 8120 | 392 |
| 546160 | 235 | 254 | ACTGAATAGCAAACACCTTG | 5-10-5 | 78 | 8107 | 8126 | 393 |
| 547299 | 237 | 256 | AAACTGAATAGCAAACACCT | 5-10-5 | 76 | 8109 | 8128 | 394 |
| 546163 | 250 | 269 | ACTTGCTGGAAGAAAACTGA | 5-10-5 | 42 | 8122 | 8141 | 395 |
| 547300 | 252 | 271 | GAACTTGCTGGAAGAAAACT | 5-10-5 | 37 | 8124 | 8143 | 396 |
| 546164 | 257 | 276 | TGATTGAACTTGCTGGAAGA | 5-10-5 | 33 | 8129 | 8148 | 397 |
| 546165 | 260 | 279 | CATTGATTGAACTTGCTGGA | 5-10-5 | 71 | 8132 | 8151 | 398 |
| 547301 | 261 | 280 | TCATTGATTGAACTTGCTGG | 5-10-5 | 80 | 8133 | 8152 | 399 |

TABLE 5-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 546166 | 263 | 282 | TGTCATTGATTGAACTTGCT | 5-10-5 | 70 | 8135 | 8154 | 400 |
| 547302 | 266 | 285 | CCATGTCATTGATTGAACTT | 5-10-5 | 58 | 8138 | 8157 | 401 |
| 546167 | 268 | 287 | CTCCATGTCATTGATTGAAC | 5-10-5 | 73 | 8140 | 8159 | 402 |
| 547303 | 270 | 289 | TTCTCCATGTCATTGATTGA | 5-10-5 | 72 | 8142 | 8161 | 403 |
| 547304 | 273 | 292 | CTTTTCTCCATGTCATTGAT | 5-10-5 | 71 | 8145 | 8164 | 404 |
| 547305 | 280 | 299 | ACCAAACCTTTTCTCCATGT | 5-10-5 | 47 | n/a | n/a | 405 |
| 546170 | 283 | 302 | GCAACCAAACCTTTTCTCCA | 5-10-5 | 54 | n/a | n/a | 406 |
| 547306 | 284 | 303 | AGCAACCAAACCTTTTCTCC | 5-10-5 | 62 | n/a | n/a | 407 |
| 547307 | 286 | 305 | GAAGCAACCAAACCTTTTCT | 5-10-5 | 58 | n/a | n/a | 408 |
| 547308 | 290 | 309 | TCAAGAAGCAACCAAACCTT | 5-10-5 | 66 | n/a | n/a | 409 |
| 547309 | 293 | 312 | CTTTCAAGAAGCAACCAAAC | 5-10-5 | 71 | 9827 | 9846 | 410 |
| 547310 | 295 | 314 | ATCTTTCAAGAAGCAACCAA | 5-10-5 | 81 | 9829 | 9848 | 411 |
| 546171 | 297 | 316 | CTATCTTTCAAGAAGCAACC | 5-10-5 | 81 | 9831 | 9850 | 412 |
| 547311 | 299 | 318 | CACTATCTTTCAAGAAGCAA | 5-10-5 | 71 | 9833 | 9852 | 413 |
| 546172 | 301 | 320 | AACACTATCTTTCAAGAAGC | 5-10-5 | 81 | 9835 | 9854 | 414 |
| 547312 | 325 | 344 | ATGTACTTTTGGCAGGGTTC | 5-10-5 | 46 | 9859 | 9878 | 415 |
| 546173 | 327 | 346 | CGATGTACTTTTGGCAGGGT | 5-10-5 | 84 | 9861 | 9880 | 416 |
| 547313 | 330 | 349 | GTTCGATGTACTTTTGGCAG | 5-10-5 | 73 | 9864 | 9883 | 417 |

TABLE 6

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 531231 | n/a | n/a | TATCACTGTACTAGTTTCCT | 5-10-5 | 86 | 14744 | 14763 | 334 |
|  |  |  |  |  |  | 14815 | 14834 |  |
|  |  |  |  |  |  | 14886 | 14905 |  |
|  |  |  |  |  |  | 14945 | 14964 |  |
|  |  |  |  |  |  | 15005 | 15024 |  |
|  |  |  |  |  |  | 15077 | 15096 |  |
|  |  |  |  |  |  | 15220 | 15239 |  |
|  |  |  |  |  |  | 15292 | 15311 |  |
|  |  |  |  |  |  | 15351 | 15370 |  |
|  |  |  |  |  |  | 15411 | 15430 |  |
|  |  |  |  |  |  | 15483 | 15502 |  |
|  |  |  |  |  |  | 15555 | 15574 |  |
|  |  |  |  |  |  | 15613 | 15632 |  |
|  |  |  |  |  |  | 15685 | 15704 |  |
|  |  |  |  |  |  | 15815 | 15834 |  |
|  |  |  |  |  |  | 15887 | 15906 |  |
|  |  |  |  |  |  | 15945 | 15964 |  |
| 546174 | 333 | 352 | CCTGTTCGATGTACTTTTGG | 5-10-5 | 74 | 9867 | 9886 | 418 |
| 547314 | 336 | 355 | GCACCTGTTCGATGTACTTT | 5-10-5 | 73 | 9870 | 9889 | 419 |
| 546175 | 338 | 357 | CTGCACCTGTTCGATGTACT | 5-10-5 | 78 | 9872 | 9891 | 420 |

TABLE 6-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 547315 | 340 | 359 | AACTGCACCTGTTCGATGTA | 5-10-5 | 50 | 9874 | 9893 | 421 |
| 547316 | 342 | 361 | GAAACTGCACCTGTTCGATG | 5-10-5 | 75 | 9876 | 9895 | 422 |
| 547317 | 344 | 363 | CAGAAACTGCACCTGTTCGA | 5-10-5 | 75 | 9878 | 9897 | 423 |
| 547318 | 345 | 364 | CCAGAAACTGCACCTGTTCG | 5-10-5 | 74 | 9879 | 9898 | 424 |
| 546177 | 348 | 367 | TGTCCAGAAACTGCACCTGT | 5-10-5 | 75 | 9882 | 9901 | 425 |
| 547319 | 351 | 370 | GAATGTCCAGAAACTGCACC | 5-10-5 | 62 | 9885 | 9904 | 426 |
| 547320 | 353 | 372 | AGGAATGTCCAGAAACTGCA | 5-10-5 | 73 | 9887 | 9906 | 427 |
| 547321 | 356 | 375 | TCAAGGAATGTCCAGAAACT | 5-10-5 | 53 | 9890 | 9909 | 428 |
| 547322 | 358 | 377 | CTTCAAGGAATGTCCAGAAA | 5-10-5 | 65 | 9892 | 9911 | 429 |
| 547323 | 361 | 380 | TTGCTTCAAGGAATGTCCAG | 5-10-5 | 56 | 9895 | 9914 | 430 |
| 547324 | 363 | 382 | CATTGCTTCAAGGAATGTCC | 5-10-5 | 76 | 9897 | 9916 | 431 |
| 547325 | 368 | 387 | GACCACATTGCTTCAAGGAA | 5-10-5 | 67 | 9902 | 9921 | 432 |
| 546181 | 369 | 388 | TGACCACATTGCTTCAAGGA | 5-10-5 | 75 | 9903 | 9922 | 433 |
| 547326 | 370 | 389 | ATGACCACATTGCTTCAAGG | 5-10-5 | 48 | 9904 | 9923 | 434 |
| 547327 | 373 | 392 | TTGATGACCACATTGCTTCA | 5-10-5 | 45 | 9907 | 9926 | 435 |
| 547328 | 375 | 394 | ATTTGATGACCACATTGCTT | 5-10-5 | 40 | 9909 | 9928 | 436 |
| 547329 | 377 | 396 | TTATTTGATGACCACATTGC | 5-10-5 | 24 | 9911 | 9930 | 437 |
| 547330 | 378 | 397 | CTTATTTGATGACCACATTG | 5-10-5 | 60 | 9912 | 9931 | 438 |
| 546183 | 380 | 399 | CACTTATTTGATGACCACAT | 5-10-5 | 69 | 9914 | 9933 | 439 |
| 547331 | 382 | 401 | AGCACTTATTTGATGACCAC | 5-10-5 | 47 | n/a | n/a | 440 |
| 546184 | 384 | 403 | CAAGCACTTATTTGATGACC | 5-10-5 | 65 | n/a | n/a | 441 |
| 547332 | 390 | 409 | CGATGGCAAGCACTTATTTG | 5-10-5 | 44 | n/a | n/a | 442 |
| 547333 | 395 | 414 | TGTCTCGATGGCAAGCACTT | 5-10-5 | 76 | n/a | n/a | 443 |
| 546186 | 396 | 415 | ATGTCTCGATGGCAAGCACT | 5-10-5 | 84 | n/a | n/a | 444 |
| 547334 | 397 | 416 | AATGTCTCGATGGCAAGCAC | 5-10-5 | 74 | n/a | n/a | 445 |
| 547335 | 402 | 421 | TTATAAATGTCTCGATGGCA | 5-10-5 | 93 | 12658 | 12677 | 446 |
| 547336 | 403 | 422 | TTTATAAATGTCTCGATGGC | 5-10-5 | 81 | 12659 | 12678 | 447 |
| 546188 | 407 | 426 | CTCCTTTATAAATGTCTCGA | 5-10-5 | 95 | 12663 | 12682 | 448 |
| 547337 | 409 | 428 | AACTCCTTTATAAATGTCTC | 5-10-5 | 84 | 12665 | 12684 | 449 |
| 547338 | 411 | 430 | TCAACTCCTTTATAAATGTC | 5-10-5 | 71 | 12667 | 12686 | 450 |
| 547339 | 413 | 432 | TATCAACTCCTTTATAAATG | 5-10-5 | 42 | 12669 | 12688 | 451 |
| 546190 | 419 | 438 | CTCTCATATCAACTCCTTTA | 5-10-5 | 92 | 12675 | 12694 | 452 |
| 547340 | 422 | 441 | CTCCTCTCATATCAACTCCT | 5-10-5 | 93 | 12678 | 12697 | 453 |
| 547341 | 424 | 443 | GACTCCTCTCATATCAACTC | 5-10-5 | 87 | 12680 | 12699 | 454 |
| 546192 | 428 | 447 | AATTGACTCCTCTCATATCA | 5-10-5 | 51 | 12684 | 12703 | 455 |
| 547342 | 433 | 452 | ATTAAAATTGACTCCTCTCA | 5-10-5 | 66 | 12689 | 12708 | 456 |
| 546193 | 434 | 453 | CATTAAAATTGACTCCTCTC | 5-10-5 | 57 | 12690 | 12709 | 457 |

TABLE 6-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 547343 | 436 | 455 | CACATTAAAATTGACTCCTC | 5-10-5 | 78 | 12692 | 12711 | 458 |
| 547344 | 438 | 457 | GACACATTAAAATTGACTCC | 5-10-5 | 80 | 12694 | 12713 | 459 |
| 547345 | 439 | 458 | AGACACATTAAAATTGACTC | 5-10-5 | 80 | 12695 | 12714 | 460 |
| 547346 | 444 | 463 | ACCTTAGACACATTAAAATT | 5-10-5 | 57 | 12700 | 12719 | 461 |
| 546195 | 448 | 467 | GCTAACCTTAGACACATTAA | 5-10-5 | 83 | 12704 | 12723 | 462 |
| 547347 | 451 | 470 | ACTGCTAACCTTAGACACAT | 5-10-5 | 82 | 12707 | 12726 | 463 |
| 546196 | 452 | 471 | CACTGCTAACCTTAGACACA | 5-10-5 | 83 | 12708 | 12727 | 464 |
| 547348 | 453 | 472 | ACACTGCTAACCTTAGACAC | 5-10-5 | 83 | 12709 | 12728 | 465 |
| 547349 | 458 | 477 | CTTCAACACTGCTAACCTTA | 5-10-5 | 88 | 12714 | 12733 | 466 |
| 546198 | 459 | 478 | TCTTCAACACTGCTAACCTT | 5-10-5 | 85 | 12715 | 12734 | 467 |
| 547350 | 464 | 483 | GGCATTCTTCAACACTGCTA | 5-10-5 | 96 | 12720 | 12739 | 468 |
| 546199 | 465 | 484 | TGGCATTCTTCAACACTGCT | 5-10-5 | 97 | 12721 | 12740 | 469 |
| 547351 | 467 | 486 | TTTGGCATTCTTCAACACTG | 5-10-5 | 92 | 12723 | 12742 | 470 |
| 546200 | 500 | 519 | AAAACTGGCAGCGAATGTTA | 5-10-5 | 91 | 12756 | 12775 | 471 |
| 547352 | 541 | 560 | CCGGTACTCTGCCTTGTGAA | 5-10-5 | 94 | 12797 | 12816 | 472 |
| 547354 | 547 | 566 | ATTGTTCCGGTACTCTGCCT | 5-10-5 | 89 | n/a | n/a | 473 |
| 546203 | 548 | 567 | AATTGTTCCGGTACTCTGCC | 5-10-5 | 76 | n/a | n/a | 474 |
| 547355 | 549 | 568 | CAATTGTTCCGGTACTCTGC | 5-10-5 | 77 | n/a | n/a | 475 |
| 546204 | 555 | 574 | AATAGGCAATTGTTCCGGTA | 5-10-5 | 91 | n/a | n/a | 476 |
| 547356 | 556 | 575 | TAATAGGCAATTGTTCCGGT | 5-10-5 | 83 | n/a | n/a | 477 |
| 547357 | 559 | 578 | CTTTAATAGGCAATTGTTCC | 5-10-5 | 78 | 14130 | 14149 | 478 |
| 546205 | 562 | 581 | GTACTTTAATAGGCAATTGT | 5-10-5 | 83 | 14133 | 14152 | 479 |
| 547359 | 569 | 588 | CGGGACTGTACTTTAATAGG | 5-10-5 | 81 | 14140 | 14159 | 480 |
| 546208 | 605 | 624 | CGTTACTCAGCACCTTTATA | 5-10-5 | 92 | 14176 | 14195 | 481 |
| 546209 | 629 | 648 | GCTTCAGTGAGAATCCAGAT | 5-10-5 | 73 | 14200 | 14219 | 482 |
| 546210 | 651 | 670 | CCAATTTCTGAAAGGGCACA | 5-10-5 | 79 | 14222 | 14241 | 483 |
| 547360 | 653 | 672 | AACCAATTTCTGAAAGGGCA | 5-10-5 | 88 | n/a | n/a | 484 |
| 547361 | 655 | 674 | GCAACCAATTTCTGAAAGGG | 5-10-5 | 46 | n/a | n/a | 485 |
| 546211 | 656 | 675 | GGCAACCAATTTCTGAAAGG | 5-10-5 | 42 | n/a | n/a | 486 |
| 546212 | 678 | 697 | AGATGCTGGAAGATGTTCAT | 5-10-5 | 48 | 26126 | 26145 | 487 |
| 547362 | 701 | 720 | CAACATCCACATCTGAGAAC | 5-10-5 | 47 | 26149 | 26168 | 488 |
| 547363 | 703 | 722 | GGCAACATCCACATCTGAGA | 5-10-5 | 84 | 26151 | 26170 | 489 |
| 546213 | 707 | 726 | CCCTGGCAACATCCACATCT | 5-10-5 | 82 | 26155 | 26174 | 490 |

TABLE 7

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 531231 | n/a | n/a | TATCACTGTACTAGTTTCCT | 5-10-5 | 88 | 14744 | 14763 | 334 |
| | | | | | | 14815 | 14834 | |
| | | | | | | 14886 | 14905 | |
| | | | | | | 14945 | 14964 | |
| | | | | | | 15005 | 15024 | |
| | | | | | | 15077 | 15096 | |
| | | | | | | 15220 | 15239 | |
| | | | | | | 15292 | 15311 | |
| | | | | | | 15351 | 15370 | |
| | | | | | | 15411 | 15430 | |
| | | | | | | 15483 | 15502 | |
| | | | | | | 15555 | 15574 | |
| | | | | | | 15613 | 15632 | |
| | | | | | | 15685 | 15704 | |
| | | | | | | 15815 | 15834 | |
| | | | | | | 15887 | 15906 | |
| | | | | | | 15945 | 15964 | |
| 547364 | 710 | 729 | GAACCCTGGCAACATCCACA | 5-10-5 | 92 | 26158 | 26177 | 491 |
| 546214 | 712 | 731 | GAGAACCCTGGCAACATCCA | 5-10-5 | 88 | 26160 | 26179 | 492 |
| 547365 | 713 | 732 | TGAGAACCCTGGCAACATCC | 5-10-5 | 81 | 26161 | 26180 | 493 |
| 547366 | 717 | 736 | GGAGTGAGAACCCTGGCAAC | 5-10-5 | 86 | 26165 | 26184 | 494 |
| 546216 | 719 | 738 | CTGGAGTGAGAACCCTGGCA | 5-10-5 | 93 | 26167 | 26186 | 495 |
| 547367 | 721 | 740 | ATCTGGAGTGAGAACCCTGG | 5-10-5 | 76 | 26169 | 26188 | 496 |
| 547368 | 723 | 742 | GCATCTGGAGTGAGAACCCT | 5-10-5 | 89 | 26171 | 26190 | 497 |
| 547369 | 725 | 744 | AAGCATCTGGAGTGAGAACC | 5-10-5 | 76 | 26173 | 26192 | 498 |
| 547370 | 728 | 747 | CAAAAGCATCTGGAGTGAGA | 5-10-5 | 73 | 26176 | 26195 | 499 |
| 546217 | 730 | 749 | CACAAAAGCATCTGGAGTGA | 5-10-5 | 83 | 26178 | 26197 | 500 |
| 546218 | 740 | 759 | TGGTCCGACACACAAAAGCA | 5-10-5 | 71 | 26188 | 26207 | 501 |
| 547371 | 741 | 760 | ATGGTCCGACACACAAAAGC | 5-10-5 | 66 | 26189 | 26208 | 502 |
| 547372 | 742 | 761 | GATGGTCCGACACACAAAAG | 5-10-5 | 32 | 26190 | 26209 | 503 |
| 547373 | 745 | 764 | GCAGATGGTCCGACACACAA | 5-10-5 | 90 | 26193 | 26212 | 504 |
| 546220 | 750 | 769 | TAGGTGCAGATGGTCCGACA | 5-10-5 | 71 | 26198 | 26217 | 505 |
| 547374 | 752 | 771 | GATAGGTGCAGATGGTCCGA | 5-10-5 | 81 | 26200 | 26219 | 506 |
| 547375 | 754 | 773 | GTGATAGGTGCAGATGGTCC | 5-10-5 | 72 | 26202 | 26221 | 507 |
| 546222 | 756 | 775 | GGGTGATAGGTGCAGATGGT | 5-10-5 | 12 | 26204 | 26223 | 508 |
| 547376 | 778 | 797 | GAATGTAAAGAAGAGGCAGT | 5-10-5 | 43 | 26226 | 26245 | 509 |
| 546224 | 780 | 799 | TAGAATGTAAAGAAGAGGCA | 5-10-5 | 65 | 26228 | 26247 | 510 |
| 547377 | 788 | 807 | CATTTGTATAGAATGTAAAG | 5-10-5 | 6 | 26236 | 26255 | 511 |
| 547378 | 790 | 809 | TACATTTGTATAGAATGTAA | 5-10-5 | 0 | 26238 | 26257 | 512 |
| 546226 | 793 | 812 | CCATACATTTGTATAGAATG | 5-10-5 | 37 | 26241 | 26260 | 513 |
| 547379 | 802 | 821 | CTCGATTTTCCATACATTTG | 5-10-5 | 37 | 26250 | 26269 | 514 |
| 547380 | 805 | 824 | TGACTCGATTTTCCATACAT | 5-10-5 | 42 | 26253 | 26272 | 515 |
| 546228 | 806 | 825 | GTGACTCGATTTTCCATACA | 5-10-5 | 60 | 26254 | 26273 | 516 |
| 547381 | 807 | 826 | TGTGACTCGATTTTCCATAC | 5-10-5 | 49 | 26255 | 26274 | 517 |
| 547382 | 810 | 829 | CTTTGTGACTCGATTTTCCA | 5-10-5 | 62 | 26258 | 26277 | 518 |

TABLE 7-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 547383 | 812 | 831 | TTCTTTGTGACTCGATTTTC | 5-10-5 | 37 | n/a | n/a | 519 |
| 546229 | 816 | 835 | ACATTTCTTTGTGACTCGAT | 5-10-5 | 19 | n/a | n/a | 520 |
| 547384 | 818 | 837 | AAACATTTCTTTGTGACTCG | 5-10-5 | 50 | n/a | n/a | 521 |
| 547385 | 847 | 866 | TGTGCCACTTTCAGATGTTT | 5-10-5 | 80 | 27111 | 27130 | 522 |
| 546230 | 848 | 867 | GTGTGCCACTTTCAGATGTT | 5-10-5 | 70 | 27112 | 27131 | 523 |
| 546231 | 852 | 871 | CTTGGTGTGCCACTTTCAGA | 5-10-5 | 79 | 27116 | 27135 | 524 |
| 547386 | 853 | 872 | ACTTGGTGTGCCACTTTCAG | 5-10-5 | 78 | 27117 | 27136 | 525 |
| 546232 | 857 | 876 | AGGAACTTGGTGTGCCACTT | 5-10-5 | 86 | 27121 | 27140 | 526 |
| 547387 | 878 | 897 | TGGTGTTTTCTTGAGGAGTA | 5-10-5 | 73 | 27142 | 27161 | 527 |
| 546233 | 879 | 898 | ATGGTGTTTTCTTGAGGAGT | 5-10-5 | 69 | 27143 | 27162 | 528 |
| 547388 | 880 | 899 | TATGGTGTTTTCTTGAGGAG | 5-10-5 | 55 | 27144 | 27163 | 529 |
| 547389 | 884 | 903 | CAGATATGGTGTTTTCTTGA | 5-10-5 | 61 | 27148 | 27167 | 530 |
| 546234 | 885 | 904 | CCAGATATGGTGTTTTCTTG | 5-10-5 | 69 | 27149 | 27168 | 531 |
| 547390 | 887 | 906 | ATCCAGATATGGTGTTTTCT | 5-10-5 | 63 | 27151 | 27170 | 532 |
| 547391 | 889 | 908 | ATATCCAGATATGGTGTTTT | 5-10-5 | 32 | 27153 | 27172 | 533 |
| 546235 | 893 | 912 | GGCTATATCCAGATATGGTG | 5-10-5 | 77 | 27157 | 27176 | 534 |
| 547392 | 895 | 914 | AAGGCTATATCCAGATATGG | 5-10-5 | 81 | 27159 | 27178 | 535 |
| 546236 | 900 | 919 | GTTAAAAGGCTATATCCAGA | 5-10-5 | 50 | 27164 | 27183 | 536 |
| 546237 | 903 | 922 | CAGGTTAAAAGGCTATATCC | 5-10-5 | 64 | 27167 | 27186 | 537 |
| 547393 | 905 | 924 | TGCAGGTTAAAAGGCTATAT | 5-10-5 | 73 | 27169 | 27188 | 538 |
| 547394 | 907 | 926 | TTTGCAGGTTAAAAGGCTAT | 5-10-5 | 29 | 27171 | 27190 | 539 |
| 546238 | 909 | 928 | CTTTTGCAGGTTAAAAGGCT | 5-10-5 | 63 | 27173 | 27192 | 540 |
| 546239 | 912 | 931 | GTTCTTTTGCAGGTTAAAAG | 5-10-5 | 47 | 27176 | 27195 | 541 |
| 547395 | 914 | 933 | AAGTTCTTTTGCAGGTTAAA | 5-10-5 | 15 | 27178 | 27197 | 542 |
| 546240 | 917 | 936 | GTAAAGTTCTTTTGCAGGTT | 5-10-5 | 23 | 27181 | 27200 | 543 |
| 546241 | 920 | 939 | CAGGTAAAGTTCTTTTGCAG | 5-10-5 | 69 | 27184 | 27203 | 544 |
| 547396 | 921 | 940 | TCAGGTAAAGTTCTTTTGCA | 5-10-5 | 49 | n/a | n/a | 545 |
| 547397 | 923 | 942 | GTTCAGGTAAAGTTCTTTTG | 5-10-5 | 27 | n/a | n/a | 546 |
| 546242 | 925 | 944 | GGGTTCAGGTAAAGTTCTTT | 5-10-5 | 8 | n/a | n/a | 547 |
| 547398 | 927 | 946 | CAGGGTTCAGGTAAAGTTCT | 5-10-5 | 16 | n/a | n/a | 548 |
| 547399 | 928 | 947 | GCAGGGTTCAGGTAAAGTTC | 5-10-5 | 10 | n/a | n/a | 549 |
| 547400 | 930 | 949 | TGGCAGGGTTCAGGTAAAGT | 5-10-5 | 0 | n/a | n/a | 550 |
| 547401 | 933 | 952 | GAATGGCAGGGTTCAGGTAA | 5-10-5 | 22 | n/a | n/a | 551 |
| 546243 | 934 | 953 | AGAATGGCAGGGTTCAGGTA | 5-10-5 | 16 | n/a | n/a | 552 |
| 547402 | 937 | 956 | TTTAGAATGGCAGGGTTCAG | 5-10-5 | 59 | n/a | n/a | 553 |
| 547403 | 939 | 958 | ATTTTAGAATGGCAGGGTTC | 5-10-5 | 10 | 27361 | 27380 | 554 |

TABLE 7-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 546244 | 942 | 961 | TAAATTTTAGAATGGCAGGG | 5-10-5 | 27 | 27364 | 27383 | 555 |
| 547404 | 956 | 975 | AGTCAACTCCCGGGTAAATT | 5-10-5 | 64 | 27378 | 27397 | 556 |
| 547405 | 959 | 978 | CAAAGTCAACTCCCGGGTAA | 5-10-5 | 47 | 27381 | 27400 | 557 |
| 546247 | 960 | 979 | CCAAAGTCAACTCCCGGGTA | 5-10-5 | 90 | 27382 | 27401 | 558 |
| 546248 | 963 | 982 | CCTCCAAAGTCAACTCCCGG | 5-10-5 | 86 | 27385 | 27404 | 559 |
| 547406 | 965 | 984 | CTCCTCCAAAGTCAACTCCC | 5-10-5 | 81 | 27387 | 27406 | 560 |
| 546249 | 968 | 987 | CTTCTCCTCCAAAGTCAACT | 5-10-5 | 68 | 27390 | 27409 | 561 |
| 547407 | 975 | 994 | TTCAATTCTTCTCCTCCAAA | 5-10-5 | 59 | 27397 | 27416 | 562 |
| 546250 | 977 | 996 | CATTCAATTCTTCTCCTCCA | 5-10-5 | 65 | 27399 | 27418 | 563 |
| 547408 | 980 | 999 | TCACATTCAATTCTTCTCCT | 5-10-5 | 84 | 27402 | 27421 | 564 |
| 547409 | 982 | 1001 | AGTCACATTCAATTCTTCTC | 5-10-5 | 67 | 27404 | 27423 | 565 |
| 546251 | 1007 | 1026 | GGCAAACATTCACTCCTTTA | 5-10-5 | 92 | 27429 | 27448 | 566 |

TABLE 8

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 531231 | n/a | n/a | TATCACTGTACTAGTTTCCT | 5-10-5 | 95 | 14744 | 14763 | 344 |
|  |  |  |  |  |  | 14815 | 14834 |  |
|  |  |  |  |  |  | 14886 | 14905 |  |
|  |  |  |  |  |  | 14945 | 14964 |  |
|  |  |  |  |  |  | 15005 | 15024 |  |
|  |  |  |  |  |  | 15077 | 15096 |  |
|  |  |  |  |  |  | 15220 | 15239 |  |
|  |  |  |  |  |  | 15292 | 15311 |  |
|  |  |  |  |  |  | 15351 | 15370 |  |
|  |  |  |  |  |  | 15411 | 15430 |  |
|  |  |  |  |  |  | 15483 | 15502 |  |
|  |  |  |  |  |  | 15555 | 15574 |  |
|  |  |  |  |  |  | 15613 | 15632 |  |
|  |  |  |  |  |  | 15685 | 15704 |  |
|  |  |  |  |  |  | 15815 | 15834 |  |
|  |  |  |  |  |  | 15887 | 15906 |  |
|  |  |  |  |  |  | 15945 | 15964 |  |
| 546252 | 1011 | 1030 | TCTTGGCAAACATTCACTCC | 5-10-5 | 73 | 27433 | 27452 | 567 |
| 546253 | 1014 | 1033 | GTCTCTTGGCAAACATTCAC | 5-10-5 | 98 | 27436 | 27455 | 568 |
| 547410 | 1017 | 1036 | CAAGTCTCTTGGCAAACATT | 5-10-5 | 88 | 27439 | 27458 | 569 |
| 546254 | 1019 | 1038 | TGCAAGTCTCTTGGCAAACA | 5-10-5 | 95 | 27441 | 27460 | 570 |
| 546255 | 1024 | 1043 | CTTTGTGCAAGTCTCTTGGC | 5-10-5 | 92 | 27446 | 27465 | 571 |
| 547411 | 1027 | 1046 | CATCTTTGTGCAAGTCTCTT | 5-10-5 | 79 | 27449 | 27468 | 572 |
| 546256 | 1028 | 1047 | TCATCTTTGTGCAAGTCTCT | 5-10-5 | 83 | 27450 | 27469 | 573 |
| 547412 | 1029 | 1048 | ATCATCTTTGTGCAAGTCTC | 5-10-5 | 73 | 27451 | 27470 | 574 |
| 546258 | 1036 | 1055 | ACAGCGAATCATCTTTGTGC | 5-10-5 | 74 | 27458 | 27477 | 575 |
| 546259 | 1040 | 1059 | ACTGACAGCGAATCATCTTT | 5-10-5 | 86 | 27462 | 27481 | 576 |

TABLE 8-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 546260 | 1045 | 1064 | GAAAAACTGACAGCGAATCA | 5-10-5 | 84 | 27467 | 27486 | 577 |
| 547413 | 1047 | 1066 | GTGAAAAACTGACAGCGAAT | 5-10-5 | 94 | 27469 | 27488 | 578 |
| 546263 | 1061 | 1080 | GGAGTAAAGAATAAGTGAAA | 5-10-5 | 0 | 27483 | 27502 | 579 |
| 547414 | 1063 | 1082 | TGGGAGTAAAGAATAAGTGA | 5-10-5 | 76 | 27485 | 27504 | 580 |
| 547415 | 1065 | 1084 | TCTGGGAGTAAAGAATAAGT | 5-10-5 | 71 | 27487 | 27506 | 581 |
| 546265 | 1069 | 1088 | GTCTTCTGGGAGTAAAGAAT | 5-10-5 | 65 | 27491 | 27510 | 582 |
| 546266 | 1072 | 1091 | ACAGTCTTCTGGGAGTAAAG | 5-10-5 | 63 | 27494 | 27513 | 583 |
| 547416 | 1075 | 1094 | CTTACAGTCTTCTGGGAGTA | 5-10-5 | 79 | 27497 | 27516 | 584 |
| 546267 | 1076 | 1095 | CCTTACAGTCTTCTGGGAGT | 5-10-5 | 72 | 27498 | 27517 | 585 |
| 547417 | 1077 | 1096 | TCCTTACAGTCTTCTGGGAG | 5-10-5 | 68 | 27499 | 27518 | 586 |
| 546268 | 1079 | 1098 | CTTCCTTACAGTCTTCTGGG | 5-10-5 | 93 | 27501 | 27520 | 587 |
| 547418 | 1092 | 1111 | CACTTACACTTCTCTTCCTT | 5-10-5 | 0 | n/a | n/a | 588 |
| 546270 | 1093 | 1112 | ACACTTACACTTCTCTTCCT | 5-10-5 | 32 | n/a | n/a | 589 |
| 546271 | 1097 | 1116 | AGAAACACTTACACTTCTCT | 5-10-5 | 60 | n/a | n/a | 590 |
| 547419 | 1101 | 1120 | CTTAAGAAACACTTACACTT | 5-10-5 | 51 | n/a | n/a | 591 |
| 547420 | 1112 | 1131 | CCATAGATAATCTTAAGAAA | 5-10-5 | 8 | 27633 | 27652 | 592 |
| 547421 | 1115 | 1134 | CATCCATAGATAATCTTAAG | 5-10-5 | 69 | 27636 | 27655 | 593 |
| 547422 | 1117 | 1136 | ACCATCCATAGATAATCTTA | 5-10-5 | 70 | 27638 | 27657 | 594 |
| 546275 | 1119 | 1138 | GAACCATCCATAGATAATCT | 5-10-5 | 87 | 27640 | 27659 | 595 |
| 546276 | 1123 | 1142 | TGGAGAACCATCCATAGATA | 5-10-5 | 74 | 27644 | 27663 | 596 |
| 546277 | 1146 | 1165 | TGTGTCCCATACGCAATCCT | 5-10-5 | 90 | 27667 | 27686 | 597 |
| 547423 | 1150 | 1169 | CCCTTGTGTCCCATACGCAA | 5-10-5 | 95 | 27671 | 27690 | 598 |
| 546279 | 1153 | 1172 | GCTCCCTTGTGTCCCATACG | 5-10-5 | 82 | 27674 | 27693 | 599 |
| 547424 | 1156 | 1175 | AGAGCTCCCTTGTGTCCCAT | 5-10-5 | 90 | 27677 | 27696 | 600 |
| 546280 | 1158 | 1177 | CCAGAGCTCCCTTGTGTCCC | 5-10-5 | 86 | 27679 | 27698 | 601 |
| 547425 | 1161 | 1180 | TAACCAGAGCTCCCTTGTGT | 5-10-5 | 85 | 27682 | 27701 | 602 |
| 546281 | 1162 | 1181 | GTAACCAGAGCTCCCTTGTG | 5-10-5 | 85 | 27683 | 27702 | 603 |
| 547426 | 1164 | 1183 | GAGTAACCAGAGCTCCCTTG | 5-10-5 | 92 | 27685 | 27704 | 604 |
| 547427 | 1166 | 1185 | AAGAGTAACCAGAGCTCCCT | 5-10-5 | 79 | 27687 | 27706 | 605 |
| 547428 | 1169 | 1188 | TCAAAGAGTAACCAGAGCTC | 5-10-5 | 78 | 27690 | 27709 | 606 |
| 546283 | 1171 | 1190 | TCTCAAAGAGTAACCAGAGC | 5-10-5 | 88 | 27692 | 27711 | 607 |
| 547429 | 1173 | 1192 | AATCTCAAAGAGTAACCAGA | 5-10-5 | 81 | 27694 | 27713 | 608 |

TABLE 8-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 547430 | 1174 | 1193 | CAATCTCAAAGAGTAACCAG | 5-10-5 | 70 | 27695 | 27714 | 609 |
| 546284 | 1176 | 1195 | CACAATCTCAAAGAGTAACC | 5-10-5 | 89 | 27697 | 27716 | 610 |
| 546285 | 1180 | 1199 | GTTACACAATCTCAAAGAGT | 5-10-5 | 76 | 27701 | 27720 | 611 |
| 547431 | 1184 | 1203 | CAGTGTTACACAATCTCAAA | 5-10-5 | 67 | 27705 | 27724 | 612 |
| 547432 | 1186 | 1205 | CCCAGTGTTACACAATCTCA | 5-10-5 | 90 | 27707 | 27726 | 613 |
| 547433 | 1189 | 1208 | GTCCCCAGTGTTACACAATC | 5-10-5 | 63 | 27710 | 27729 | 614 |
| 546287 | 1192 | 1211 | GTTGTCCCCAGTGTTACACA | 5-10-5 | 82 | 27713 | 27732 | 615 |
| 546288 | 1240 | 1259 | GTTTGTTCCTCCAACAATGC | 5-10-5 | 78 | 27916 | 27935 | 616 |
| 547434 | 1243 | 1262 | AGAGTTTGTTCCTCCAACAA | 5-10-5 | 54 | 27919 | 27938 | 617 |
| 547435 | 1248 | 1267 | CAAGAAGAGTTTGTTCCTCC | 5-10-5 | 85 | 27924 | 27943 | 618 |
| 546290 | 1251 | 1270 | CCCCAAGAAGAGTTTGTTCC | 5-10-5 | 86 | 27927 | 27946 | 619 |
| 547436 | 1253 | 1272 | CTCCCCAAGAAGAGTTTGTT | 5-10-5 | 0 | 27929 | 27948 | 620 |
| 547437 | 1255 | 1274 | CTCTCCCCAAGAAGAGTTTG | 5-10-5 | 50 | 27931 | 27950 | 621 |
| 547438 | 1261 | 1280 | GGGCCACTCTCCCCAAGAAG | 5-10-5 | 82 | 27937 | 27956 | 622 |
| 546291 | 1263 | 1282 | CAGGGCCACTCTCCCCAAGA | 5-10-5 | 81 | 27939 | 27958 | 623 |
| 547439 | 1298 | 1317 | TCTGAGCTGTCAGCTTCACC | 5-10-5 | 85 | 27974 | 27993 | 624 |
| 546293 | 1301 | 1320 | GCCTCTGAGCTGTCAGCTTC | 5-10-5 | 64 | 27977 | 27996 | 625 |
| 547440 | 1327 | 1346 | TCCTATGAGTGACCCTCCAC | 5-10-5 | 67 | 28003 | 28022 | 626 |
| 546294 | 1328 | 1347 | GTCCTATGAGTGACCCTCCA | 5-10-5 | 72 | 28004 | 28023 | 627 |
| 547441 | 1331 | 1350 | GGTGTCCTATGAGTGACCCT | 5-10-5 | 62 | 28007 | 28026 | 628 |
| 547442 | 1332 | 1351 | TGGTGTCCTATGAGTGACCC | 5-10-5 | 42 | 28008 | 28027 | 629 |
| 547443 | 1336 | 1355 | CCACTGGTGTCCTATGAGTG | 5-10-5 | 70 | 28012 | 28031 | 630 |
| 546295 | 1337 | 1356 | CCCACTGGTGTCCTATGAGT | 5-10-5 | 67 | 28013 | 28032 | 631 |
| 546296 | 1370 | 1389 | GAAGCCCATCAAAGCAGTGG | 5-10-5 | 27 | n/a | n/a | 632 |
| 546297 | 1397 | 1416 | TATAGATGCGCCAAACATCC | 5-10-5 | 82 | 30475 | 30494 | 633 |
| 547444 | 1398 | 1417 | CTATAGATGCGCCAAACATC | 5-10-5 | 71 | 30476 | 30495 | 634 |
| 547445 | 1402 | 1421 | GCCACTATAGATGCGCCAAA | 5-10-5 | 97 | 30480 | 30499 | 635 |
| 546299 | 1404 | 1423 | ATGCCACTATAGATGCGCCA | 5-10-5 | 84 | 30482 | 30501 | 636 |
| 546300 | 1424 | 1443 | TAATGTCTGACAGATTTAAA | 5-10-5 | 58 | 30502 | 30521 | 637 |
| 546301 | 1427 | 1446 | TTGTAATGTCTGACAGATTT | 5-10-5 | 93 | 30505 | 30524 | 638 |
| 546302 | 1444 | 1463 | TGAGAAAGGTGTATCTTTTG | 5-10-5 | 87 | 30522 | 30541 | 639 |
| 547446 | 1447 | 1466 | TTGTGAGAAAGGTGTATCTT | 5-10-5 | 84 | 30525 | 30544 | 640 |
| 546303 | 1448 | 1467 | TTTGTGAGAAAGGTGTATCT | 5-10-5 | 77 | 30526 | 30545 | 641 |
| 547447 | 1449 | 1468 | ATTTGTGAGAAAGGTGTATC | 5-10-5 | 80 | 30527 | 30546 | 642 |

TABLE 9

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 531231 | n/a | n/a | TATCACTGTACTAGTTTCCT | 5-10-5 | 96 | 14744 | 14763 | 334 |
| | | | | | | 14815 | 14834 | |
| | | | | | | 14886 | 14905 | |
| | | | | | | 14945 | 14964 | |
| | | | | | | 15005 | 15024 | |
| | | | | | | 15077 | 15096 | |
| | | | | | | 15220 | 15239 | |
| | | | | | | 15292 | 15311 | |
| | | | | | | 15351 | 15370 | |
| | | | | | | 15411 | 15430 | |
| | | | | | | 15483 | 15502 | |
| | | | | | | 15555 | 15574 | |
| | | | | | | 15613 | 15632 | |
| | | | | | | 15685 | 15704 | |
| | | | | | | 15815 | 15834 | |
| | | | | | | 15887 | 15906 | |
| | | | | | | 15945 | 15964 | |
| 547448 | 1451 | 1470 | TTATTTGTGAGAAAGGTGTA | 5-10-5 | 75 | 30529 | 30548 | 643 |
| 547449 | 1453 | 1472 | TTTTATTTGTGAGAAAGGTG | 5-10-5 | 71 | 30531 | 30550 | 644 |
| 546304 | 1454 | 1473 | CTTTTATTTGTGAGAAAGGT | 5-10-5 | 94 | 30532 | 30551 | 645 |
| 547450 | 1456 | 1475 | CTCTTTTATTTGTGAGAAAG | 5-10-5 | 71 | 30534 | 30553 | 646 |
| 547451 | 1471 | 1490 | TTGGTGAATAATAATCTCTT | 5-10-5 | 75 | 30549 | 30568 | 647 |
| 546306 | 1472 | 1491 | TTTGGTGAATAATAATCTCT | 5-10-5 | 65 | 30550 | 30569 | 648 |
| 547452 | 1474 | 1493 | GTTTTGGTGAATAATAATCT | 5-10-5 | 47 | 30552 | 30571 | 649 |
| 546307 | 1478 | 1497 | TATAGTTTTGGTGAATAATA | 5-10-5 | 12 | 30556 | 30575 | 650 |
| 546308 | 1482 | 1501 | ACTTTATAGTTTTGGTGAAT | 5-10-5 | 57 | 30560 | 30579 | 651 |
| 546309 | 1492 | 1511 | CCCTTCTGAGACTTTATAGT | 5-10-5 | 88 | 30570 | 30589 | 652 |
| 546310 | 1496 | 1515 | GATTCCCTTCTGAGACTTTA | 5-10-5 | 78 | 30574 | 30593 | 653 |
| 546311 | 1499 | 1518 | CATGATTCCCTTCTGAGACT | 5-10-5 | 79 | 30577 | 30596 | 654 |
| 547453 | 1500 | 1519 | TCATGATTCCCTTCTGAGAC | 5-10-5 | 81 | 30578 | 30597 | 655 |
| 547454 | 1502 | 1521 | TATCATGATTCCCTTCTGAG | 5-10-5 | 92 | 30580 | 30599 | 656 |
| 547455 | 1503 | 1522 | ATATCATGATTCCCTTCTGA | 5-10-5 | 88 | 30581 | 30600 | 657 |
| 547456 | 1506 | 1525 | GCGATATCATGATTCCCTTC | 5-10-5 | 89 | 30584 | 30603 | 658 |
| 546313 | 1507 | 1526 | GGCGATATCATGATTCCCTT | 5-10-5 | 60 | 30585 | 30604 | 659 |
| 547457 | 1509 | 1528 | AAGGCGATATCATGATTCCC | 5-10-5 | 89 | 30587 | 30606 | 660 |
| 547458 | 1513 | 1532 | TATCAAGGCGATATCATGAT | 5-10-5 | 84 | 30591 | 30610 | 661 |
| 547459 | 1519 | 1538 | GAGTTTTATCAAGGCGATAT | 5-10-5 | 28 | 30597 | 30616 | 662 |
| 547460 | 1522 | 1541 | CTGGAGTTTTATCAAGGCGA | 5-10-5 | 72 | 30600 | 30619 | 663 |
| 546316 | 1524 | 1543 | GCCTGGAGTTTTATCAAGGC | 5-10-5 | 51 | 30602 | 30621 | 664 |
| 546317 | 1528 | 1547 | AGGAGCCTGGAGTTTTATCA | 5-10-5 | 12 | 30606 | 30625 | 665 |
| 546318 | 1534 | 1553 | ATTCAAAGGAGCCTGGAGTT | 5-10-5 | 47 | 30612 | 30631 | 666 |
| 547461 | 1537 | 1556 | GTAATTCAAAGGAGCCTGGA | 5-10-5 | 49 | 30615 | 30634 | 667 |
| 547462 | 1539 | 1558 | GTGTAATTCAAAGGAGCCTG | 5-10-5 | 59 | 30617 | 30636 | 668 |
| 546319 | 1541 | 1560 | CAGTGTAATTCAAAGGAGCC | 5-10-5 | 50 | 30619 | 30638 | 669 |
| 547463 | 1564 | 1583 | TAGGCATATTGGTTTTTGGA | 5-10-5 | 74 | 31870 | 31889 | 670 |

TABLE 9-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 546320 | 1566 | 1585 | GGTAGGCATATTGGTTTTTG | 5-10-5 | 72 | 31872 | 31891 | 671 |
| 546321 | 1569 | 1588 | GAAGGTAGGCATATTGGTTT | 5-10-5 | 53 | 31875 | 31894 | 672 |
| 546322 | 1584 | 1603 | CTTGTGTCACCTTTGGAAGG | 5-10-5 | 74 | 31890 | 31909 | 673 |
| 547464 | 1585 | 1604 | GCTTGTGTCACCTTTGGAAG | 5-10-5 | 95 | 31891 | 31910 | 674 |
| 546323 | 1587 | 1606 | GTGCTTGTGTCACCTTTGGA | 5-10-5 | 94 | 31893 | 31912 | 675 |
| 547465 | 1592 | 1611 | AAATTGTGCTTGTGTCACCT | 5-10-5 | 88 | 31898 | 31917 | 676 |
| 547466 | 1596 | 1615 | GTATAAATTGTGCTTGTGTC | 5-10-5 | 82 | 31902 | 31921 | 677 |
| 546324 | 1597 | 1616 | GGTATAAATTGTGCTTGTGT | 5-10-5 | 73 | 31903 | 31922 | 678 |
| 547467 | 1598 | 1617 | TGGTATAAATTGTGCTTGTG | 5-10-5 | 80 | 31904 | 31923 | 679 |
| 547468 | 1600 | 1619 | GTTGGTATAAATTGTGCTTG | 5-10-5 | 61 | 31906 | 31925 | 680 |
| 546325 | 1602 | 1621 | CAGTTGGTATAAATTGTGCT | 5-10-5 | 74 | 31908 | 31927 | 681 |
| 546326 | 1607 | 1626 | CCCAACAGTTGGTATAAATT | 5-10-5 | 62 | 31913 | 31932 | 682 |
| 547469 | 1610 | 1629 | TTACCCAACAGTTGGTATAA | 5-10-5 | 67 | 31916 | 31935 | 683 |
| 546327 | 1612 | 1631 | GGTTACCCAACAGTTGGTAT | 5-10-5 | 95 | 31918 | 31937 | 684 |
| 546328 | 1624 | 1643 | GAAGCCCCATCCGGTTACCC | 5-10-5 | 84 | 31930 | 31949 | 685 |
| 547470 | 1628 | 1647 | TCGAGAAGCCCCATCCGGTT | 5-10-5 | 70 | 31934 | 31953 | 686 |
| 546329 | 1631 | 1650 | CCTTCGAGAAGCCCCATCCG | 5-10-5 | 18 | 31937 | 31956 | 687 |
| 546330 | 1636 | 1655 | TTTCTCCTTCGAGAAGCCCC | 5-10-5 | 55 | 31942 | 31961 | 688 |
| 547471 | 1638 | 1657 | CCTTTCTCCTTCGAGAAGCC | 5-10-5 | 58 | 31944 | 31963 | 689 |
| 547472 | 1641 | 1660 | TCACCTTTCTCCTTCGAGAA | 5-10-5 | 44 | n/a | n/a | 690 |
| 546331 | 1642 | 1661 | TTCACCTTTCTCCTTCGAGA | 5-10-5 | 59 | n/a | n/a | 691 |
| 547473 | 1649 | 1668 | TTTGGATTTCACCTTTCTCC | 5-10-5 | 5 | n/a | n/a | 692 |
| 547474 | 1659 | 1678 | TGTAGAATATTTTGGATTTC | 5-10-5 | 51 | 33103 | 33122 | 693 |
| 547475 | 1686 | 1705 | TTTGTTACCAAAGGAATATT | 5-10-5 | 44 | 33130 | 33149 | 694 |
| 547476 | 1688 | 1707 | CATTTGTTACCAAAGGAATA | 5-10-5 | 75 | 33132 | 33151 | 695 |
| 546336 | 1689 | 1708 | TCATTTGTTACCAAAGGAAT | 5-10-5 | 66 | 33133 | 33152 | 696 |
| 547477 | 1692 | 1711 | TCTTCATTTGTTACCAAAGG | 5-10-5 | 74 | 33136 | 33155 | 697 |
| 547478 | 1695 | 1714 | CATTCTTCATTTGTTACCAA | 5-10-5 | 85 | 33139 | 33158 | 698 |
| 546339 | 1712 | 1731 | CTTGATATCTTTTCTGGCAT | 5-10-5 | 65 | 33156 | 33175 | 699 |
| 546340 | 1716 | 1735 | TAATCTTGATATCTTTTCTG | 5-10-5 | 30 | 33160 | 33179 | 700 |
| 547479 | 1718 | 1737 | TATAATCTTGATATCTTTTC | 5-10-5 | 48 | 33162 | 33181 | 701 |
| 547480 | 1756 | 1775 | TTCTTTATAGCCAGCACAGA | 5-10-5 | 60 | 33200 | 33219 | 702 |
| 547481 | 1758 | 1777 | CCTTCTTTATAGCCAGCACA | 5-10-5 | 71 | 33202 | 33221 | 703 |
| 547482 | 1760 | 1779 | CCCCTTCTTTATAGCCAGCA | 5-10-5 | 90 | 33204 | 33223 | 704 |
| 546343 | 1761 | 1780 | CCCCCTTCTTTATAGCCAGC | 5-10-5 | 97 | 33205 | 33224 | 705 |
| 547483 | 1762 | 1781 | TCCCCCTTCTTTATAGCCAG | 5-10-5 | 71 | 33206 | 33225 | 706 |

TABLE 9-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 546345 | 1773 | 1792 | CAAGCATCTTTTCCCCCTTC | 5-10-5 | 86 | 33217 | 33236 | 707 |
| 546346 | 1796 | 1815 | AGGGACCACCTGAATCTCCC | 5-10-5 | 83 | 33895 | 33914 | 708 |
| 547484 | 1799 | 1818 | CTAAGGGACCACCTGAATCT | 5-10-5 | 69 | 33898 | 33917 | 709 |
| 546347 | 1800 | 1819 | ACTAAGGGACCACCTGAATC | 5-10-5 | 28 | 33899 | 33918 | 710 |
| 547485 | 1803 | 1822 | CAAACTAAGGGACCACCTGA | 5-10-5 | 49 | 33902 | 33921 | 711 |
| 546348 | 1804 | 1823 | GCAAACTAAGGGACCACCTG | 5-10-5 | 79 | 33903 | 33922 | 712 |
| 547486 | 1805 | 1824 | TGCAAACTAAGGGACCACCT | 5-10-5 | 89 | 33904 | 33923 | 713 |
| 546349 | 1810 | 1829 | GTGTTTGCAAACTAAGGGAC | 5-10-5 | 48 | 33909 | 33928 | 714 |
| 547487 | 1811 | 1830 | TGTGTTTGCAAACTAAGGGA | 5-10-5 | 72 | 33910 | 33929 | 715 |
| 546350 | 1868 | 1887 | CCCTGCGGGCACAGCCTTCA | 5-10-5 | 88 | 33967 | 33986 | 716 |
| 546351 | 1873 | 1892 | TTGCTCCCTGCGGGCACAGC | 5-10-5 | 82 | 33972 | 33991 | 717 |
| 546352 | 1880 | 1899 | CACCAGGTTGCTCCCTGCGG | 5-10-5 | 75 | 33979 | 33998 | 718 |
| 547488 | 1881 | 1900 | ACACCAGGTTGCTCCCTGCG | 5-10-5 | 71 | 33980 | 33999 | 719 |

TABLE 10

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 531231 | n/a | n/a | TATCACTGTACTAGTTTCCT | 5-10-5 | 72 | 14744 14815 14886 14945 15005 15077 15220 15292 15351 15411 15483 15555 15613 15685 15815 15887 15945 | 14763 14834 14905 14964 15024 15096 15239 15311 15370 15430 15502 15574 15632 15704 15834 15906 15964 | 334 |
| 547448 | 1451 | 1470 | TTATTTGTGAGAAAGGTGTA | 5-10-5 | 83 | 30529 | 30548 | 643 |
| 547449 | 1453 | 1472 | TTTTATTTGTGAGAAAGGTG | 5-10-5 | 73 | 30531 | 30550 | 644 |
| 546304 | 1454 | 1473 | CTTTTATTTGTGAGAAAGGT | 5-10-5 | 86 | 30532 | 30551 | 645 |
| 547450 | 1456 | 1475 | CTCTTTTATTTGTGAGAAAG | 5-10-5 | 67 | 30534 | 30553 | 646 |
| 547451 | 1471 | 1490 | TTGGTGAATAATAATCTCTT | 5-10-5 | 64 | 30549 | 30568 | 647 |
| 546306 | 1472 | 1491 | TTTGGTGAATAATAATCTCT | 5-10-5 | 71 | 30550 | 30569 | 648 |
| 547452 | 1474 | 1493 | GTTTTGGTGAATAATAATCT | 5-10-5 | 62 | 30552 | 30571 | 649 |
| 546307 | 1478 | 1497 | TATAGTTTTGGTGAATAATA | 5-10-5 | 0 | 30556 | 30575 | 650 |
| 546308 | 1482 | 1501 | ACTTTATAGTTTTGGTGAAT | 5-10-5 | 43 | 30560 | 30579 | 651 |

TABLE 10-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 546309 | 1492 | 1511 | CCCTTCTGAGACTTTATAGT | 5-10-5 | 81 | 30570 | 30589 | 652 |
| 546310 | 1496 | 1515 | GATTCCCTTCTGAGACTTTA | 5-10-5 | 67 | 30574 | 30593 | 653 |
| 546311 | 1499 | 1518 | CATGATTCCCTTCTGAGACT | 5-10-5 | 76 | 30577 | 30596 | 654 |
| 547453 | 1500 | 1519 | TCATGATTCCCTTCTGAGAC | 5-10-5 | 81 | 30578 | 30597 | 655 |
| 547454 | 1502 | 1521 | TATCATGATTCCCTTCTGAG | 5-10-5 | 78 | 30580 | 30599 | 656 |
| 547455 | 1503 | 1522 | ATATCATGATTCCCTTCTGA | 5-10-5 | 66 | 30581 | 30600 | 657 |
| 547456 | 1506 | 1525 | GCGATATCATGATTCCCTTC | 5-10-5 | 96 | 30584 | 30603 | 658 |
| 546313 | 1507 | 1526 | GGCGATATCATGATTCCCTT | 5-10-5 | 75 | 30585 | 30604 | 659 |
| 547457 | 1509 | 1528 | AAGGCGATATCATGATTCCC | 5-10-5 | 92 | 30587 | 30606 | 660 |
| 547458 | 1513 | 1532 | TATCAAGGCGATATCATGAT | 5-10-5 | 64 | 30591 | 30610 | 661 |
| 547459 | 1519 | 1538 | GAGTTTTATCAAGGCGATAT | 5-10-5 | 51 | 30597 | 30616 | 662 |
| 547460 | 1522 | 1541 | CTGGAGTTTTATCAAGGCGA | 5-10-5 | 75 | 30600 | 30619 | 663 |
| 546316 | 1524 | 1543 | GCCTGGAGTTTTATCAAGGC | 5-10-5 | 60 | 30602 | 30621 | 664 |
| 546317 | 1528 | 1547 | AGGAGCCTGGAGTTTTATCA | 5-10-5 | 31 | 30606 | 30625 | 665 |
| 546318 | 1534 | 1553 | ATTCAAAGGAGCCTGGAGTT | 5-10-5 | 46 | 30612 | 30631 | 666 |
| 547461 | 1537 | 1556 | GTAATTCAAAGGAGCCTGGA | 5-10-5 | 55 | 30615 | 30634 | 667 |
| 547462 | 1539 | 1558 | GTGTAATTCAAAGGAGCCTG | 5-10-5 | 54 | 30617 | 30636 | 668 |
| 546319 | 1541 | 1560 | CAGTGTAATTCAAAGGAGCC | 5-10-5 | 61 | 30619 | 30638 | 669 |
| 547463 | 1564 | 1583 | TAGGCATATTGGTTTTGGA | 5-10-5 | 84 | 31870 | 31889 | 670 |
| 546320 | 1566 | 1585 | GGTAGGCATATTGGTTTTG | 5-10-5 | 69 | 31872 | 31891 | 671 |
| 546321 | 1569 | 1588 | GAAGGTAGGCATATTGGTTT | 5-10-5 | 56 | 31875 | 31894 | 672 |
| 546322 | 1584 | 1603 | CTTGTGTCACCTTTGGAAGG | 5-10-5 | 68 | 31890 | 31909 | 673 |
| 547464 | 1585 | 1604 | GCTTGTGTCACCTTTGGAAG | 5-10-5 | 84 | 31891 | 31910 | 674 |
| 546323 | 1587 | 1606 | GTGCTTGTGTCACCTTTGGA | 5-10-5 | 80 | 31893 | 31912 | 675 |
| 547465 | 1592 | 1611 | AAATTGTGCTTGTGTCACCT | 5-10-5 | 85 | 31898 | 31917 | 676 |
| 547466 | 1596 | 1615 | GTATAAATTGTGCTTGTGTC | 5-10-5 | 43 | 31902 | 31921 | 677 |
| 546324 | 1597 | 1616 | GGTATAAATTGTGCTTGTGT | 5-10-5 | 82 | 31903 | 31922 | 678 |
| 547467 | 1598 | 1617 | TGGTATAAATTGTGCTTGTG | 5-10-5 | 65 | 31904 | 31923 | 679 |
| 547468 | 1600 | 1619 | GTTGGTATAAATTGTGCTTG | 5-10-5 | 46 | 31906 | 31925 | 680 |
| 546325 | 1602 | 1621 | CAGTTGGTATAAATTGTGCT | 5-10-5 | 79 | 31908 | 31927 | 681 |
| 546326 | 1607 | 1626 | CCCAACAGTTGGTATAAATT | 5-10-5 | 64 | 31913 | 31932 | 682 |
| 547469 | 1610 | 1629 | TTACCCAACAGTTGGTATAA | 5-10-5 | 50 | 31916 | 31935 | 683 |
| 546327 | 1612 | 1631 | GGTTACCCAACAGTTGGTAT | 5-10-5 | 84 | 31918 | 31937 | 684 |
| 546328 | 1624 | 1643 | GAAGCCCCATCCGGTTACCC | 5-10-5 | 81 | 31930 | 31949 | 685 |
| 547470 | 1628 | 1647 | TCGAGAAGCCCCATCCGGTT | 5-10-5 | 68 | 31934 | 31953 | 686 |
| 546329 | 1631 | 1650 | CCTTCGAGAAGCCCCATCCG | 5-10-5 | 8 | 31937 | 31956 | 687 |

TABLE 10-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 546330 | 1636 | 1655 | TTTCTCCTTCGAGAAGCCCC | 5-10-5 | 67 | 31942 | 31961 | 688 |
| 547471 | 1638 | 1657 | CCTTTCTCCTTCGAGAAGCC | 5-10-5 | 43 | 31944 | 31963 | 689 |
| 547472 | 1641 | 1660 | TCACCTTTCTCCTTCGAGAA | 5-10-5 | 42 | n/a | n/a | 690 |
| 546331 | 1642 | 1661 | TTCACCTTTCTCCTTCGAGA | 5-10-5 | 44 | n/a | n/a | 691 |
| 547473 | 1649 | 1668 | TTTGGATTTCACCTTTCTCC | 5-10-5 | 26 | n/a | n/a | 692 |
| 547474 | 1659 | 1678 | TGTAGAATATTTTGGATTTC | 5-10-5 | 34 | 33103 | 33122 | 693 |
| 547475 | 1686 | 1705 | TTTGTTACCAAAGGAATATT | 5-10-5 | 42 | 33130 | 33149 | 694 |
| 547476 | 1688 | 1707 | CATTTGTTACCAAAGGAATA | 5-10-5 | 71 | 33132 | 33151 | 695 |
| 546336 | 1689 | 1708 | TCATTTGTTACCAAAGGAAT | 5-10-5 | 73 | 33133 | 33152 | 696 |
| 547477 | 1692 | 1711 | TCTTCATTTGTTACCAAAGG | 5-10-5 | 68 | 33136 | 33155 | 697 |
| 547478 | 1695 | 1714 | CATTCTTCATTTGTTACCAA | 5-10-5 | 55 | 33139 | 33158 | 698 |
| 546339 | 1712 | 1731 | CTTGATATCTTTTCTGGCAT | 5-10-5 | 64 | 33156 | 33175 | 699 |
| 546340 | 1716 | 1735 | TAATCTTGATATCTTTTCTG | 5-10-5 | 56 | 33160 | 33179 | 700 |
| 547479 | 1718 | 1737 | TATAATCTTGATATCTTTTC | 5-10-5 | 9 | 33162 | 33181 | 701 |
| 547480 | 1756 | 1775 | TTCTTTATAGCCAGCACAGA | 5-10-5 | 49 | 33200 | 33219 | 702 |
| 547481 | 1758 | 1777 | CCTTCTTTATAGCCAGCACA | 5-10-5 | 77 | 33202 | 33221 | 703 |
| 547482 | 1760 | 1779 | CCCCTTCTTTATAGCCAGCA | 5-10-5 | 65 | 33204 | 33223 | 704 |
| 546343 | 1761 | 1780 | CCCCCTTCTTTATAGCCAGC | 5-10-5 | 91 | 33205 | 33224 | 705 |
| 547483 | 1762 | 1781 | TCCCCCTTCTTTATAGCCAG | 5-10-5 | 77 | 33206 | 33225 | 706 |
| 546345 | 1773 | 1792 | CAAGCATCTTTTCCCCCTTC | 5-10-5 | 80 | 33217 | 33236 | 707 |
| 546346 | 1796 | 1815 | AGGGACCACCTGAATCTCCC | 5-10-5 | 70 | 33895 | 33914 | 708 |
| 547484 | 1799 | 1818 | CTAAGGGACCACCTGAATCT | 5-10-5 | 64 | 33898 | 33917 | 709 |
| 546347 | 1800 | 1819 | ACTAAGGGACCACCTGAATC | 5-10-5 | 22 | 33899 | 33918 | 710 |
| 547485 | 1803 | 1822 | CAAACTAAGGGACCACCTGA | 5-10-5 | 66 | 33902 | 33921 | 711 |
| 546348 | 1804 | 1823 | GCAAACTAAGGGACCACCTG | 5-10-5 | 76 | 33903 | 33922 | 712 |
| 547486 | 1805 | 1824 | TGCAAACTAAGGGACCACCT | 5-10-5 | 78 | 33904 | 33923 | 713 |
| 546349 | 1810 | 1829 | GTGTTTGCAAACTAAGGGAC | 5-10-5 | 35 | 33909 | 33928 | 714 |
| 547487 | 1811 | 1830 | TGTGTTTGCAAACTAAGGGA | 5-10-5 | 61 | 33910 | 33929 | 715 |
| 546350 | 1868 | 1887 | CCCTGCGGGCACAGCCTTCA | 5-10-5 | 74 | 33967 | 33986 | 716 |
| 546351 | 1873 | 1892 | TTGCTCCCTGCGGGCACAGC | 5-10-5 | 60 | 33972 | 33991 | 717 |
| 546352 | 1880 | 1899 | CACCAGGTTGCTCCCTGCGG | 5-10-5 | 74 | 33979 | 33998 | 718 |
| 547488 | 1881 | 1900 | ACACCAGGTTGCTCCCTGCG | 5-10-5 | 72 | 33980 | 33999 | 719 |

TABLE 11

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 531231 | n/a | n/a | TATCACTGTACTAGTTTCCT | 5-10-5 | 90 | 14744 | 14763 | 334 |
|  |  |  |  |  |  | 14815 | 14834 |  |
|  |  |  |  |  |  | 14886 | 14905 |  |
|  |  |  |  |  |  | 14945 | 14964 |  |
|  |  |  |  |  |  | 15005 | 15024 |  |
|  |  |  |  |  |  | 15077 | 15096 |  |
|  |  |  |  |  |  | 15220 | 15239 |  |
|  |  |  |  |  |  | 15292 | 15311 |  |
|  |  |  |  |  |  | 15351 | 15370 |  |
|  |  |  |  |  |  | 15411 | 15430 |  |
|  |  |  |  |  |  | 15483 | 15502 |  |
|  |  |  |  |  |  | 15555 | 15574 |  |
|  |  |  |  |  |  | 15613 | 15632 |  |
|  |  |  |  |  |  | 15685 | 15704 |  |
|  |  |  |  |  |  | 15815 | 15834 |  |
|  |  |  |  |  |  | 15887 | 15906 |  |
|  |  |  |  |  |  | 15945 | 15964 |  |
| 547489 | 1883 | 1902 | AGACACCAGGTTGCTCCCTG | 5-10-5 | 34 | 33982 | 34001 | 720 |
| 547490 | 1885 | 1904 | GTAGACACCAGGTTGCTCCC | 5-10-5 | 55 | 33984 | 34003 | 721 |
| 546353 | 1900 | 1919 | CTCAGCGACTTTGGTGTAGA | 5-10-5 | 55 | 33999 | 34018 | 722 |
| 546354 | 1903 | 1922 | GTACTCAGCGACTTTGGTGT | 5-10-5 | 47 | 34002 | 34021 | 723 |
| 547491 | 1906 | 1925 | CATGTACTCAGCGACTTTGG | 5-10-5 | 47 | 34005 | 34024 | 724 |
| 547492 | 1911 | 1930 | CAGTCCATGTACTCAGCGAC | 5-10-5 | 62 | 34010 | 34029 | 725 |
| 546356 | 1913 | 1932 | TCCAGTCCATGTACTCAGCG | 5-10-5 | 60 | 34012 | 34031 | 726 |
| 546357 | 1947 | 1966 | GCTTTTCCATCACTGCTCTG | 5-10-5 | 79 | 34046 | 34065 | 727 |
| 546358 | 1951 | 1970 | CTGAGCTTTTCCATCACTGC | 5-10-5 | 83 | 34050 | 34069 | 728 |
| 547493 | 1952 | 1971 | TCTGAGCTTTTCCATCACTG | 5-10-5 | 72 | 34051 | 34070 | 729 |
| 546359 | 1955 | 1974 | GCATCTGAGCTTTTCCATCA | 5-10-5 | 79 | 34054 | 34073 | 730 |
| 546360 | 1958 | 1977 | ACTGCATCTGAGCTTTTCCA | 5-10-5 | 13 | 34057 | 34076 | 731 |
| 547494 | 1963 | 1982 | TGGTGACTGCATCTGAGCTT | 5-10-5 | 70 | 34062 | 34081 | 732 |
| 547495 | 1965 | 1984 | GCTGGTGACTGCATCTGAGC | 5-10-5 | 61 | 34064 | 34083 | 733 |
| 547496 | 1967 | 1986 | ATGCTGGTGACTGCATCTGA | 5-10-5 | 80 | 34066 | 34085 | 734 |
| 546362 | 1969 | 1988 | TCATGCTGGTGACTGCATCT | 5-10-5 | 71 | 34068 | 34087 | 735 |
| 546363 | 1973 | 1992 | CTTCTCATGCTGGTGACTGC | 5-10-5 | 81 | 34072 | 34091 | 736 |
| 547497 | 1977 | 1996 | ACTGCTTCTCATGCTGGTGA | 5-10-5 | 68 | 34076 | 34095 | 737 |
| 546364 | 1979 | 1998 | GGACTGCTTCTCATGCTGGT | 5-10-5 | 61 | 34078 | 34097 | 738 |
| 547498 | 1981 | 2000 | CTGGACTGCTTCTCATGCTG | 5-10-5 | 44 | 34080 | 34099 | 739 |
| 547499 | 1983 | 2002 | CTCTGGACTGCTTCTCATGC | 5-10-5 | 65 | 34082 | 34101 | 740 |
| 546365 | 1986 | 2005 | AGACTCTGGACTGCTTCTCA | 5-10-5 | 64 | 34085 | 34104 | 741 |
| 547500 | 1989 | 2008 | CCTAGACTCTGGACTGCTTC | 5-10-5 | 65 | 34088 | 34107 | 742 |
| 546366 | 1991 | 2010 | TGCCTAGACTCTGGACTGCT | 5-10-5 | 79 | 34090 | 34109 | 743 |
| 547501 | 1993 | 2012 | ATTGCCTAGACTCTGGACTG | 5-10-5 | 55 | 34092 | 34111 | 744 |
| 546367 | 1997 | 2016 | AAAAATTGCCTAGACTCTGG | 5-10-5 | 61 | 34096 | 34115 | 745 |
| 546368 | 2003 | 2022 | GGTTGTAAAAATTGCCTAGA | 5-10-5 | 44 | 34102 | 34121 | 746 |
| 547502 | 2006 | 2025 | TCAGGTTGTAAAAATTGCCT | 5-10-5 | 64 | 34105 | 34124 | 747 |

TABLE 11-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 546369 | 2007 | 2026 | CTCAGGTTGTAAAAATTGCC | 5-10-5 | 51 | 34106 | 34125 | 748 |
| 547503 | 2008 | 2027 | ACTCAGGTTGTAAAAATTGC | 5-10-5 | 66 | 34107 | 34126 | 749 |
| 547504 | 2010 | 2029 | GAACTCAGGTTGTAAAAATT | 5-10-5 | 37 | 34109 | 34128 | 750 |
| 546370 | 2014 | 2033 | ACTTGAACTCAGGTTGTAAA | 5-10-5 | 34 | 34113 | 34132 | 751 |
| 547505 | 2015 | 2034 | GACTTGAACTCAGGTTGTAA | 5-10-5 | 69 | 34114 | 34133 | 752 |
| 546372 | 2021 | 2040 | GAATTTGACTTGAACTCAGG | 5-10-5 | 49 | 34120 | 34139 | 753 |
| 546373 | 2025 | 2044 | CTCAGAATTTGACTTGAACT | 5-10-5 | 59 | 34124 | 34143 | 754 |
| 547506 | 2028 | 2047 | AGGCTCAGAATTTGACTTGA | 5-10-5 | 78 | 34127 | 34146 | 755 |
| 547507 | 2029 | 2048 | CAGGCTCAGAATTTGACTTG | 5-10-5 | 56 | 34128 | 34147 | 756 |
| 546374 | 2030 | 2049 | CCAGGCTCAGAATTTGACTT | 5-10-5 | 50 | 34129 | 34148 | 757 |
| 547508 | 2032 | 2051 | CCCCAGGCTCAGAATTTGAC | 5-10-5 | 69 | 34131 | 34150 | 758 |
| 547509 | 2034 | 2053 | CCCCCCAGGCTCAGAATTTG | 5-10-5 | 58 | 34133 | 34152 | 759 |
| 546375 | 2036 | 2055 | GACCCCCCAGGCTCAGAATT | 5-10-5 | 48 | 34135 | 34154 | 760 |
| 547510 | 2041 | 2060 | ATGAGGACCCCCAGGCTCA | 5-10-5 | 40 | 34140 | 34159 | 761 |
| 547511 | 2042 | 2061 | GATGAGGACCCCCCAGGCTC | 5-10-5 | 53 | 34141 | 34160 | 762 |
| 547512 | 2045 | 2064 | GCAGATGAGGACCCCCCAGG | 5-10-5 | 74 | 34144 | 34163 | 763 |
| 547513 | 2046 | 2065 | TGCAGATGAGGACCCCCCAG | 5-10-5 | 72 | 34145 | 34164 | 764 |
| 546378 | 2048 | 2067 | TTTGCAGATGAGGACCCCCC | 5-10-5 | 79 | 34147 | 34166 | 765 |
| 546379 | 2056 | 2075 | CTCCATGCTTTGCAGATGAG | 5-10-5 | 69 | 34155 | 34174 | 766 |
| 546380 | 2062 | 2081 | GCCACTCTCCATGCTTTGCA | 5-10-5 | 81 | 34161 | 34180 | 767 |
| 547514 | 2066 | 2085 | AGATGCCACTCTCCATGCTT | 5-10-5 | 85 | 34165 | 34184 | 768 |
| 546381 | 2068 | 2087 | GAAGATGCCACTCTCCATGC | 5-10-5 | 73 | 34167 | 34186 | 769 |
| 547515 | 2069 | 2088 | AGAAGATGCCACTCTCCATG | 5-10-5 | 58 | 34168 | 34187 | 770 |
| 546382 | 2072 | 2091 | CAAAGAAGATGCCACTCTCC | 5-10-5 | 58 | 34171 | 34190 | 771 |
| 547516 | 2076 | 2095 | GATGCAAAGAAGATGCCACT | 5-10-5 | 48 | 34175 | 34194 | 772 |
| 546383 | 2077 | 2096 | GGATGCAAAGAAGATGCCAC | 5-10-5 | 57 | 34176 | 34195 | 773 |
| 547517 | 2079 | 2098 | TAGGATGCAAAGAAGATGCC | 5-10-5 | 57 | 34178 | 34197 | 774 |
| 547518 | 2083 | 2102 | TCCTTAGGATGCAAAGAAGA | 5-10-5 | 51 | 34182 | 34201 | 775 |
| 546384 | 2085 | 2104 | CGTCCTTAGGATGCAAAGAA | 5-10-5 | 81 | 34184 | 34203 | 776 |
| 546385 | 2120 | 2139 | ATTGTCCTCAGCAGCTCTGA | 5-10-5 | 67 | 34219 | 34238 | 777 |
| 547519 | n/a | n/a | CCAGACATTGTCCTCAGCAG | 5-10-5 | 76 | 34225 | 34244 | 778 |
| 546386 | n/a | n/a | AGCCAGACATTGTCCTCAGC | 5-10-5 | 78 | 34227 | 34246 | 779 |
| 547520 | n/a | n/a | TCAGCCAGACATTGTCCTCA | 5-10-5 | 76 | 34229 | 34248 | 780 |
| 547521 | n/a | n/a | CTTCAGCCAGACATTGTCCT | 5-10-5 | 58 | 34231 | 34250 | 781 |
| 546387 | n/a | n/a | AGCGGGCTTCAGCCAGACAT | 5-10-5 | 77 | 34237 | 34256 | 782 |
| 547522 | n/a | n/a | GAAAGCGGGCTTCAGCCAGA | 5-10-5 | 73 | 34240 | 34259 | 783 |

TABLE 11-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 546388 | n/a | n/a | CTGAAAGCGGGCTTCAGCCA | 5-10-5 | 71 | 34242 | 34261 | 784 |
| 546389 | 2147 | 2166 | CGTGCTGAAAGCGGGCTTCA | 5-10-5 | 71 | 34246 | 34265 | 785 |
| 546390 | 2165 | 2184 | GTCAGCCCCTGGTTACGGCG | 5-10-5 | 70 | 34264 | 34283 | 786 |
| 547523 | 2167 | 2186 | TTGTCAGCCCCTGGTTACGG | 5-10-5 | 69 | 34266 | 34285 | 787 |
| 547524 | 2169 | 2188 | CATTGTCAGCCCCTGGTTAC | 5-10-5 | 58 | 34268 | 34287 | 788 |
| 546391 | 2170 | 2189 | GCATTGTCAGCCCCTGGTTA | 5-10-5 | 54 | 34269 | 34288 | 789 |
| 547525 | 2174 | 2193 | CCTCGCATTGTCAGCCCCTG | 5-10-5 | 78 | 34273 | 34292 | 790 |
| 546392 | 2176 | 2195 | GACCTCGCATTGTCAGCCCC | 5-10-5 | 72 | 34275 | 34294 | 791 |
| 547526 | 2178 | 2197 | GCGACCTCGCATTGTCAGCC | 5-10-5 | 59 | 34277 | 34296 | 792 |
| 547527 | 2185 | 2204 | CTCAGTTGCGACCTCGCATT | 5-10-5 | 58 | 34284 | 34303 | 793 |
| 546393 | 2186 | 2205 | TCTCAGTTGCGACCTCGCAT | 5-10-5 | 77 | 34285 | 34304 | 794 |
| 546394 | 2196 | 2215 | GTCATGGAGATCTCAGTTGC | 5-10-5 | 71 | 34295 | 34314 | 795 |
| 547528 | 2200 | 2219 | CACAGTCATGGAGATCTCAG | 5-10-5 | 78 | 34299 | 34318 | 796 |

TABLE 12

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 531231 | n/a | n/a | TATCACTGTACTAGTTTCCT | 5-10-5 | 90 | 14744 14815 14886 14945 15005 15077 15220 15292 15351 15411 15483 15555 15613 15685 15815 15887 15945 | 14763 14834 14905 14964 15024 15096 15239 15311 15370 15430 15502 15574 15632 15704 15834 15906 15964 | 334 |
| 546403 | n/a | n/a | CCATGAACATCCTATCCGTG | 5-10-5 | 83 | 3282 | 3301 | 797 |
| 546406 | n/a | n/a | TGTCCTGTCAACATATTCCA | 5-10-5 | 80 | 3299 | 3318 | 798 |
| 546409 | n/a | n/a | GGGTTTCTGCCAACAGTTTC | 5-10-5 | 77 | 3326 | 3345 | 799 |
| 546410 | n/a | n/a | GACTTTGGGTTTCTGCCAAC | 5-10-5 | 83 | 3332 | 3351 | 800 |
| 546411 | n/a | n/a | ATATTGACTTTGGGTTTCTG | 5-10-5 | 56 | 3337 | 3356 | 801 |
| 546412 | n/a | n/a | GGCTTCAATATTGACTTTGG | 5-10-5 | 84 | 3344 | 3363 | 802 |
| 546416 | n/a | n/a | CTGCAGGCAATATTTTGCTT | 5-10-5 | 62 | 3364 | 3383 | 803 |
| 546418 | n/a | n/a | ATGTGGCACTGCAGGCAATA | 5-10-5 | 72 | 3372 | 3391 | 804 |
| 546419 | n/a | n/a | TTCTAATGTGGCACTGCAGG | 5-10-5 | 65 | 3377 | 3396 | 805 |

TABLE 12-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 546421 | n/a | n/a | TCAAGCTGTTCTAATGTGGC | 5-10-5 | 71 | 3385 | 3404 | 806 |
| 546422 | n/a | n/a | ACGGTCTTCAAGCTGTTCTA | 5-10-5 | 72 | 3392 | 3411 | 807 |
| 546425 | n/a | n/a | GGTCAATCTGACTAGTGAAT | 5-10-5 | 69 | 2284 | 2303 | 808 |
| 546426 | n/a | n/a | TCTCTGGTCAATCTGACTAG | 5-10-5 | 49 | 2289 | 2308 | 809 |
| 546429 | n/a | n/a | GCCCACCAACAATCTCTGGT | 5-10-5 | 84 | 2301 | 2320 | 810 |
| 546432 | n/a | n/a | GACCCCAACAGACAGCCCAC | 5-10-5 | 62 | 2315 | 2334 | 811 |
| 546444 | n/a | n/a | CCAGAATCATGCCTTGTGGG | 5-10-5 | 61 | 4765 | 4784 | 812 |
| 546447 | n/a | n/a | GTCACCATAGACCCAGAATC | 5-10-5 | 68 | 4777 | 4796 | 813 |
| 546450 | n/a | n/a | GTGGCCCTCTTAAGTCACCA | 5-10-5 | 73 | 4790 | 4809 | 814 |
| 546453 | n/a | n/a | CTCATTGTTGTGTGGCCCTC | 5-10-5 | 82 | 4801 | 4820 | 815 |
| 546459 | n/a | n/a | GTAGCCATACATCTGAGGAA | 5-10-5 | 46 | 4830 | 4849 | 816 |
| 546461 | n/a | n/a | ATGTTTATTGTAGCCATACA | 5-10-5 | 53 | 4839 | 4858 | 817 |
| 546492 | n/a | n/a | CTCGCCTTTGTGACTCGATT | 5-10-5 | 61 | 26263 | 26282 | 818 |
| 546493 | n/a | n/a | CATACTCGCCTTTGTGACTC | 5-10-5 | 35 | 26267 | 26286 | 819 |
| 546494 | n/a | n/a | GCATACTCGCCTTTGTGACT | 5-10-5 | 67 | 26268 | 26287 | 820 |
| 546495 | n/a | n/a | TGCATACTCGCCTTTGTGAC | 5-10-5 | 65 | 26269 | 26288 | 821 |
| 546395 | 2209 | 2228 | TTCACAACACACAGTCATGG | 5-10-5 | 72 | 34308 | 34327 | 822 |
| 546397 | 2233 | 2252 | TTTTTTGATCTTTCACCATT | 5-10-5 | 55 | n/a | n/a | 823 |
| 546496 | n/a | n/a | ATGCATACTCGCCTTTGTGA | 5-10-5 | 54 | 26270 26301 | 26289 26320 | 824 |
| 546497 | n/a | n/a | CATGCATACTCGCCTTTGTG | 5-10-5 | 56 | 26271 26302 | 26290 26321 | 825 |
| 546498 | n/a | n/a | CCATGCATACTCGCCTTTGT | 5-10-5 | 65 | 26272 26303 | 26291 26322 | 826 |
| 547529 | 2203 | 2222 | ACACACAGTCATGGAGATCT | 5-10-5 | 49 | 34302 | 34321 | 827 |
| 547530 | 2206 | 2225 | ACAACACACAGTCATGGAGA | 5-10-5 | 63 | 34305 | 34324 | 828 |
| 547531 | 2213 | 2232 | TTATTTCACAACACACAGTC | 5-10-5 | 69 | 34312 | 34331 | 829 |
| 546499 | n/a | n/a | TCCATGCATACTCGCCTTTG | 5-10-5 | 20 | 26273 | 26292 | 830 |
| 546500 | n/a | n/a | TTCCATGCATACTCGCCTTT | 5-10-5 | 46 | 26274 | 26293 | 831 |
| 546501 | n/a | n/a | TTTCCATGCATACTCGCCTT | 5-10-5 | 53 | 26275 | 26294 | 832 |
| 546502 | n/a | n/a | GATTTTCCATGCATACTCGC | 5-10-5 | 37 | 26278 | 26297 | 833 |
| 546503 | n/a | n/a | GTGATGCGATTTTCCATGCA | 5-10-5 | 53 | 26285 | 26304 | 834 |
| 546508 | n/a | n/a | GCAGCAAGTGCTCCCCATGC | 5-10-5 | 43 | 26317 | 26336 | 835 |
| 546511 | n/a | n/a | GTGATGAAAGTACAGCAGCA | 5-10-5 | 50 | 26331 | 26350 | 836 |
| 546683 | n/a | n/a | TCCTATCCGTGTTCAGCTGT | 5-10-5 | 69 | 3273 | 3292 | 837 |
| 546684 | n/a | n/a | TACTCTCTACATACTCAGGA | 5-10-5 | 71 | 3561 | 3580 | 838 |
| 546687 | n/a | n/a | TGAGACCTCCAGACTACTGT | 5-10-5 | 76 | 3847 | 3866 | 839 |
| 546690 | n/a | n/a | CTCTGCTGGTTTTAGACCAC | 5-10-5 | 44 | 4027 | 4046 | 840 |

TABLE 12-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 546695 | n/a | n/a | GGGACAATCTCCACCCCGA | 5-10-5 | 36 | 4225 | 4244 | 841 |
| 546698 | n/a | n/a | TGCAGAGTGTCATCTGCGAA | 5-10-5 | 59 | 4387 | 4406 | 842 |
| 546700 | n/a | n/a | TGGTTCCCTAGCGGTCCAGA | 5-10-5 | 78 | 4561 | 4580 | 843 |
| 546705 | n/a | n/a | CCCCTGTAGTTGGCTGTGGT | 5-10-5 | 66 | 5046 | 5065 | 844 |
| 546707 | n/a | n/a | GCAAGTCAAAGAGTGTCCAC | 5-10-5 | 73 | 5283 | 5302 | 845 |
| 546710 | n/a | n/a | GAAGCCTGTTAGAGTTGGCC | 5-10-5 | 73 | 5576 | 5595 | 846 |
| 546719 | n/a | n/a | CCCCCATGTCCATGGACTTT | 5-10-5 | 55 | 6329 | 6348 | 847 |
| 547532 | n/a | n/a | CTGCCAACAGTTTCAACTTT | 5-10-5 | 65 | 3320 | 3339 | 848 |
| 547533 | n/a | n/a | TTTTGCTTGGCTTCAATATT | 5-10-5 | 23 | 3352 | 3371 | 849 |
| 547534 | n/a | n/a | ATCTGACTAGTGAATGGCTT | 5-10-5 | 72 | 2279 | 2298 | 850 |
| 547535 | n/a | n/a | AGACAGCCCACCAACAATCT | 5-10-5 | 28 | 2306 | 2325 | 851 |
| 547536 | n/a | n/a | TGCATAGACCCCAACAGACA | 5-10-5 | 48 | 2321 | 2340 | 852 |
| 547537 | n/a | n/a | CCTGTGCATAGACCCCAACA | 5-10-5 | 65 | 2325 | 2344 | 853 |
| 547538 | n/a | n/a | CCAGCAGAAATCCTGTGCAT | 5-10-5 | 77 | 2336 | 2355 | 854 |
| 547539 | n/a | n/a | AGAACTCCAGCAGAAATCCT | 5-10-5 | 43 | 2342 | 2361 | 855 |
| 547540 | n/a | n/a | TTGTGTGGCCCTCTTAAGTC | 5-10-5 | 44 | 4794 | 4813 | 856 |
| 547541 | n/a | n/a | TATAGATGTTTATTGTAGCC | 5-10-5 | 36 | 4844 | 4863 | 857 |
| 547542 | n/a | n/a | ATACTCGCCTTTGTGACTCG | 5-10-5 | 35 | 26266 | 26285 | 858 |
| 547543 | n/a | n/a | TTTTCCATGCATACTCGCCT | 5-10-5 | 54 | 26276 | 26295 | 859 |
| 547544 | n/a | n/a | TCGCCTTTGTGATGCGATTT | 5-10-5 | 15 | 26293 | 26312 | 860 |
| 547545 | n/a | n/a | ATACTCGCCTTTGTGATGCG | 5-10-5 | 43 | 26297 | 26316 | 861 |
| 547546 | n/a | n/a | CATACTCGCCTTTGTGATGC | 5-10-5 | 11 | 26298 | 26317 | 862 |
| 547547 | n/a | n/a | GCATACTCGCCTTTGTGATG | 5-10-5 | 42 | 26299 | 26318 | 863 |
| 547548 | n/a | n/a | TGCATACTCGCCTTTGTGAT | 5-10-5 | 61 | 26300 | 26319 | 864 |
| 547549 | n/a | n/a | CCCATGCATACTCGCCTTTG | 5-10-5 | 36 | 26304 | 26323 | 865 |
| 547550 | n/a | n/a | CCCCATGCATACTCGCCTTT | 5-10-5 | 53 | 26305 | 26324 | 866 |
| 547551 | n/a | n/a | TCCCCATGCATACTCGCCTT | 5-10-5 | 38 | 26306 | 26325 | 867 |
| 547552 | n/a | n/a | CTCCCCATGCATACTCGCCT | 5-10-5 | 53 | 26307 | 26326 | 868 |
| 547553 | n/a | n/a | TGCTCCCCATGCATACTCGC | 5-10-5 | 64 | 26309 | 26328 | 869 |
| 547554 | n/a | n/a | GCTCTGATTGGGTCACCACA | 5-10-5 | 50 | 5743 | 5762 | 870 |
| 547555 | n/a | n/a | TGTCTCCTTCCACTTGCTCC | 5-10-5 | 58 | 5923 | 5942 | 871 |
| 547556 | n/a | n/a | GCCATTTTATCCCTGAGATT | 5-10-5 | 55 | 6130 | 6149 | 872 |
| 547557 | n/a | n/a | CTGTGCTGTATTTTGGAGCC | 5-10-5 | 59 | 6413 | 6432 | 873 |

TABLE 13

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 531231 | n/a | n/a | TATCACTGTACTAGTTTCCT | 5-10-5 | 85 | 14744 | 14763 | 334 |
|  |  |  |  |  |  | 14815 | 14834 |  |
|  |  |  |  |  |  | 14886 | 14905 |  |
|  |  |  |  |  |  | 14945 | 14964 |  |
|  |  |  |  |  |  | 15005 | 15024 |  |
|  |  |  |  |  |  | 15077 | 15096 |  |
|  |  |  |  |  |  | 15220 | 15239 |  |
|  |  |  |  |  |  | 15292 | 15311 |  |
|  |  |  |  |  |  | 15351 | 15370 |  |
|  |  |  |  |  |  | 15411 | 15430 |  |
|  |  |  |  |  |  | 15483 | 15502 |  |
|  |  |  |  |  |  | 15555 | 15574 |  |
|  |  |  |  |  |  | 15613 | 15632 |  |
|  |  |  |  |  |  | 15685 | 15704 |  |
|  |  |  |  |  |  | 15815 | 15834 |  |
|  |  |  |  |  |  | 15887 | 15906 |  |
|  |  |  |  |  |  | 15945 | 15964 |  |
| 546732 | n/a | n/a | GGATTTGGCCCTGAGCCCCA | 5-10-5 | 14 | 6933 | 6952 | 874 |
| 546735 | n/a | n/a | CAACCTGTCCATTCCCTGGG | 5-10-5 | 46 | 7082 | 7101 | 875 |
| 546739 | n/a | n/a | ATTCGGTGTCTTTACTGGCT | 5-10-5 | 89 | 7228 | 7247 | 876 |
| 546746 | n/a | n/a | TCCTGTTGCCTGACATGCTA | 5-10-5 | 65 | 7694 | 7713 | 877 |
| 546747 | n/a | n/a | CTCCCACTGACTGACTACTC | 5-10-5 | 64 | 7904 | 7923 | 878 |
| 546749 | n/a | n/a | GCTGGTCCTTGAACCCCGTG | 5-10-5 | 53 | 8259 | 8278 | 879 |
| 546753 | n/a | n/a | CTGGCTCACTATAGGCCCCA | 5-10-5 | 91 | 8655 | 8674 | 880 |
| 546756 | n/a | n/a | ATAAGCATCTCTCTGACCTA | 5-10-5 | 47 | 9105 | 9124 | 881 |
| 546763 | n/a | n/a | GCTTCCCCAATACTTGCTGG | 5-10-5 | 84 | 9695 | 9714 | 882 |
| 546765 | n/a | n/a | GTGTCCAGAATACTGCCCCA | 5-10-5 | 82 | 10053 | 10072 | 883 |
| 546770 | n/a | n/a | GTGGACGACTGCCCTGTGCC | 5-10-5 | 74 | 10435 | 10454 | 884 |
| 546773 | n/a | n/a | TCTCTAGCATCCTAGTCCTC | 5-10-5 | 67 | 10586 | 10605 | 885 |
| 546780 | n/a | n/a | ATACTGGCTAAGTCAGGCCC | 5-10-5 | 83 | 10982 | 11001 | 886 |
| 546784 | n/a | n/a | GGCAGGGAGGTGGATTATTC | 5-10-5 | 58 | 11440 | 11459 | 887 |
| 546789 | n/a | n/a | GCTTCTCTATCTCCCAGTGT | 5-10-5 | 79 | 12228 | 12247 | 888 |
| 546791 | n/a | n/a | GATGCATGCAGCAATACAGG | 5-10-5 | 52 | 12385 | 12404 | 889 |
| 546795 | n/a | n/a | GTCTCGATGGCAAGCTGTAC | 5-10-5 | 72 | 12650 | 12669 | 890 |
| 546796 | n/a | n/a | GTACTCACCGGTACTCTGCC | 5-10-5 | 82 | 12804 | 12823 | 891 |
| 546799 | n/a | n/a | ATGAAGGGCGAGGCGCAGTG | 5-10-5 | 5 | 13258 | 13277 | 892 |
| 546803 | n/a | n/a | CCCCATACATCTATGCAAAT | 5-10-5 | 40 | 13551 | 13570 | 893 |
| 546804 | n/a | n/a | ACATGACTCCAGTGATGGAT | 5-10-5 | 57 | 13632 | 13651 | 894 |
| 546808 | n/a | n/a | AAAATGACACCAAAATTCGC | 5-10-5 | 0 | 13841 | 13860 | 895 |
| 546811 | n/a | n/a | TGGACATCCTTCCCCTCGCA | 5-10-5 | 49 | 13967 | 13986 | 896 |
| 546817 | n/a | n/a | GCTCTGAGCCTTCCGCCTCT | 5-10-5 | 77 | 14472 | 14491 | 897 |
| 546822 | n/a | n/a | ACTAGTTTCCTATAACTGCT | 5-10-5 | 32 | 14735 | 14754 | 898 |
| 546823 | n/a | n/a | TACTAGTTTCCTATAACTGC | 5-10-5 | 44 | 14736 | 14755 | 899 |
| 546824 | n/a | n/a | GTACTAGTTTCCTATAACTG | 5-10-5 | 79 | 14737 | 14756 | 900 |
| 546825 | n/a | n/a | GTATCACTGTACTAGTTTCC | 5-10-5 | 96 | 14745 | 14764 | 901 |

TABLE 13-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| | | | | | | 14816 | 14835 | |
| | | | | | | 14887 | 14906 | |
| | | | | | | 14946 | 14965 | |
| | | | | | | 15006 | 15025 | |
| | | | | | | 15078 | 15097 | |
| | | | | | | 15221 | 15240 | |
| | | | | | | 15293 | 15312 | |
| | | | | | | 15352 | 15371 | |
| | | | | | | 15412 | 15431 | |
| | | | | | | 15484 | 15503 | |
| | | | | | | 15556 | 15575 | |
| | | | | | | 15614 | 15633 | |
| | | | | | | 15686 | 15705 | |
| | | | | | | 15816 | 15835 | |
| | | | | | | 15888 | 15907 | |
| | | | | | | 15946 | 15965 | |
| 546826 | n/a | n/a | AGTATCACTGTACTAGTTTC | 5-10-5 | 90 | 14746 | 14765 | 902 |
| | | | | | | 14817 | 14836 | |
| | | | | | | 14888 | 14907 | |
| | | | | | | 14947 | 14966 | |
| | | | | | | 15007 | 15026 | |
| | | | | | | 15079 | 15098 | |
| | | | | | | 15222 | 15241 | |
| | | | | | | 15294 | 15313 | |
| | | | | | | 15353 | 15372 | |
| | | | | | | 15413 | 15432 | |
| | | | | | | 15485 | 15504 | |
| | | | | | | 15557 | 15576 | |
| | | | | | | 15615 | 15634 | |
| | | | | | | 15687 | 15706 | |
| | | | | | | 15817 | 15836 | |
| | | | | | | 15889 | 15908 | |
| | | | | | | 15947 | 15966 | |
| 546827 | n/a | n/a | CAGTATCACTGTACTAGTTT | 5-10-5 | 98 | 14747 | 14766 | 903 |
| | | | | | | 14818 | 14837 | |
| | | | | | | 14889 | 14908 | |
| | | | | | | 14948 | 14967 | |
| | | | | | | 15008 | 15027 | |
| | | | | | | 15080 | 15099 | |
| | | | | | | 15152 | 15171 | |
| | | | | | | 15223 | 15242 | |
| | | | | | | 15295 | 15314 | |
| | | | | | | 15354 | 15373 | |
| | | | | | | 15414 | 15433 | |
| | | | | | | 15486 | 15505 | |
| | | | | | | 15558 | 15577 | |
| | | | | | | 15616 | 15635 | |
| | | | | | | 15688 | 15707 | |
| | | | | | | 15818 | 15837 | |
| | | | | | | 15890 | 15909 | |
| | | | | | | 15948 | 15967 | |
| 546828 | n/a | n/a | ACAGTATCACTGTACTAGTT | 5-10-5 | 95 | 14748 | 14767 | 904 |
| | | | | | | 14819 | 14838 | |
| | | | | | | 14890 | 14909 | |
| | | | | | | 14949 | 14968 | |
| | | | | | | 15009 | 15028 | |
| | | | | | | 15081 | 15100 | |
| | | | | | | 15153 | 15172 | |
| | | | | | | 15224 | 15243 | |
| | | | | | | 15296 | 15315 | |
| | | | | | | 15355 | 15374 | |
| | | | | | | 15415 | 15434 | |
| | | | | | | 15487 | 15506 | |
| | | | | | | 15559 | 15578 | |
| | | | | | | 15617 | 15636 | |
| | | | | | | 15689 | 15708 | |
| | | | | | | 15819 | 15838 | |
| | | | | | | 15891 | 15910 | |
| | | | | | | 15949 | 15968 | |

TABLE 13-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 546829 | n/a | n/a | AACAGTATCACTGTACTAGT | 5-10-5 | 94 | 14749 | 14768 | 905 |
| | | | | | | 14820 | 14839 | |
| | | | | | | 14891 | 14910 | |
| | | | | | | 14950 | 14969 | |
| | | | | | | 15010 | 15029 | |
| | | | | | | 15082 | 15101 | |
| | | | | | | 15154 | 15173 | |
| | | | | | | 15225 | 15244 | |
| | | | | | | 15297 | 15316 | |
| | | | | | | 15356 | 15375 | |
| | | | | | | 15416 | 15435 | |
| | | | | | | 15488 | 15507 | |
| | | | | | | 15560 | 15579 | |
| | | | | | | 15618 | 15637 | |
| | | | | | | 15690 | 15709 | |
| | | | | | | 15820 | 15839 | |
| | | | | | | 15892 | 15911 | |
| | | | | | | 15950 | 15969 | |
| 546830 | n/a | n/a | TAACAGTATCACTGTACTAG | 5-10-5 | 78 | 14750 | 14769 | 906 |
| | | | | | | 14821 | 14840 | |
| | | | | | | 14892 | 14911 | |
| | | | | | | 14951 | 14970 | |
| | | | | | | 15011 | 15030 | |
| | | | | | | 15083 | 15102 | |
| | | | | | | 15155 | 15174 | |
| | | | | | | 15226 | 15245 | |
| | | | | | | 15298 | 15317 | |
| | | | | | | 15357 | 15376 | |
| | | | | | | 15417 | 15436 | |
| | | | | | | 15489 | 15508 | |
| | | | | | | 15561 | 15580 | |
| | | | | | | 15619 | 15638 | |
| | | | | | | 15691 | 15710 | |
| | | | | | | 15821 | 15840 | |
| | | | | | | 15893 | 15912 | |
| | | | | | | 15951 | 15970 | |
| 546831 | n/a | n/a | TCTAACAGTATCACTGTACT | 5-10-5 | 79 | 14752 | 14771 | 907 |
| | | | | | | 14823 | 14842 | |
| | | | | | | 14894 | 14913 | |
| | | | | | | 15013 | 15032 | |
| | | | | | | 15085 | 15104 | |
| | | | | | | 15228 | 15247 | |
| | | | | | | 15300 | 15319 | |
| | | | | | | 15419 | 15438 | |
| | | | | | | 15491 | 15510 | |
| | | | | | | 15621 | 15640 | |
| | | | | | | 15823 | 15842 | |
| | | | | | | 15953 | 15972 | |
| 546832 | n/a | n/a | CTCTAACAGTATCACTGTAC | 5-10-5 | 88 | 14753 | 14772 | 908 |
| | | | | | | 14824 | 14843 | |
| | | | | | | 14895 | 14914 | |
| | | | | | | 15014 | 15033 | |
| | | | | | | 15086 | 15105 | |
| | | | | | | 15229 | 15248 | |
| | | | | | | 15301 | 15320 | |
| | | | | | | 15420 | 15439 | |
| | | | | | | 15492 | 15511 | |
| | | | | | | 15622 | 15641 | |
| | | | | | | 15824 | 15843 | |
| | | | | | | 15954 | 15973 | |
| 546833 | n/a | n/a | ACTCTAACAGTATCACTGTA | 5-10-5 | 90 | 14754 | 14773 | 909 |
| | | | | | | 14825 | 14844 | |
| | | | | | | 14896 | 14915 | |
| | | | | | | 15015 | 15034 | |
| | | | | | | 15087 | 15106 | |
| | | | | | | 15230 | 15249 | |
| | | | | | | 15302 | 15321 | |
| | | | | | | 15421 | 15440 | |
| | | | | | | 15493 | 15512 | |

TABLE 13-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| | | | | | | 15623 | 15642 | |
| | | | | | | 15825 | 15844 | |
| | | | | | | 15955 | 15974 | |
| 546834 | n/a | n/a | AACTCTAACAGTATCACTGT | 5-10-5 | 86 | 14755 | 14774 | 910 |
| | | | | | | 14826 | 14845 | |
| | | | | | | 14897 | 14916 | |
| | | | | | | 15016 | 15035 | |
| | | | | | | 15088 | 15107 | |
| | | | | | | 15231 | 15250 | |
| | | | | | | 15303 | 15322 | |
| | | | | | | 15422 | 15441 | |
| | | | | | | 15494 | 15513 | |
| | | | | | | 15624 | 15643 | |
| | | | | | | 15826 | 15845 | |
| | | | | | | 15956 | 15975 | |
| 546835 | n/a | n/a | TAACTCTAACAGTATCACTG | 5-10-5 | 86 | 14756 | 14775 | 911 |
| | | | | | | 14827 | 14846 | |
| | | | | | | 14898 | 14917 | |
| | | | | | | 15017 | 15036 | |
| | | | | | | 15089 | 15108 | |
| | | | | | | 15232 | 15251 | |
| | | | | | | 15304 | 15323 | |
| | | | | | | 15423 | 15442 | |
| | | | | | | 15495 | 15514 | |
| | | | | | | 15625 | 15644 | |
| | | | | | | 15827 | 15846 | |
| | | | | | | 15957 | 15976 | |
| 546836 | n/a | n/a | ATAACTCTAACAGTATCACT | 5-10-5 | 30 | 14757 | 14776 | 912 |
| | | | | | | 14828 | 14847 | |
| | | | | | | 14899 | 14918 | |
| | | | | | | 15018 | 15037 | |
| | | | | | | 15090 | 15109 | |
| | | | | | | 15233 | 15252 | |
| | | | | | | 15305 | 15324 | |
| | | | | | | 15424 | 15443 | |
| | | | | | | 15496 | 15515 | |
| | | | | | | 15626 | 15645 | |
| | | | | | | 15828 | 15847 | |
| | | | | | | 15958 | 15977 | |
| 546837 | n/a | n/a | TATAACTCTAACAGTATCAC | 5-10-5 | 0 | 14758 | 14777 | 913 |
| | | | | | | 14829 | 14848 | |
| | | | | | | 14900 | 14919 | |
| | | | | | | 15019 | 15038 | |
| | | | | | | 15091 | 15110 | |
| | | | | | | 15234 | 15253 | |
| | | | | | | 15306 | 15325 | |
| | | | | | | 15425 | 15444 | |
| | | | | | | 15497 | 15516 | |
| | | | | | | 15627 | 15646 | |
| | | | | | | 15829 | 15848 | |
| | | | | | | 15959 | 15978 | |
| 546838 | n/a | n/a | CTATAACTCTAACAGTATCA | 5-10-5 | 43 | 14759 | 14778 | 914 |
| | | | | | | 14830 | 14849 | |
| | | | | | | 14901 | 14920 | |
| | | | | | | 15020 | 15039 | |
| | | | | | | 15092 | 15111 | |
| | | | | | | 15235 | 15254 | |
| | | | | | | 15307 | 15326 | |
| | | | | | | 15426 | 15445 | |
| | | | | | | 15498 | 15517 | |
| | | | | | | 15628 | 15647 | |
| | | | | | | 15830 | 15849 | |
| | | | | | | 15960 | 15979 | |
| 546839 | n/a | n/a | CCTATAACTCTAACAGTATC | 5-10-5 | 47 | 14760 | 14779 | 915 |
| | | | | | | 14831 | 14850 | |
| | | | | | | 14902 | 14921 | |
| | | | | | | 15021 | 15040 | |

TABLE 13-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| | | | | | | 15093 | 15112 | |
| | | | | | | 15236 | 15255 | |
| | | | | | | 15308 | 15327 | |
| | | | | | | 15427 | 15446 | |
| | | | | | | 15499 | 15518 | |
| | | | | | | 15629 | 15648 | |
| | | | | | | 15831 | 15850 | |
| | | | | | | 15961 | 15980 | |
| 546840 | n/a | n/a | CTGTCCTATAACTCTAACAG | 5-10-5 | 53 | 14764 14835 | 14783 14854 | 916 |
| 546841 | n/a | n/a | CACTGTCCTATAACTCTAAC | 5-10-5 | 38 | 14766 14837 | 14785 14856 | 917 |
| 546842 | n/a | n/a | TCACTGTCCTATAACTCTAA | 5-10-5 | 54 | 14767 14838 | 14786 14857 | 918 |
| 546843 | n/a | n/a | TATCACTGTCCTATAACTCT | 5-10-5 | 52 | 14769 14840 | 14788 14859 | 919 |
| 546844 | n/a | n/a | GTCCTATATCACTGTCCTAT | 5-10-5 | 75 | 14775 14846 15180 15716 | 14794 14865 15199 15735 | 920 |
| 546845 | n/a | n/a | TGTCCTATATCACTGTCCTA | 5-10-5 | 75 | 14776 14847 15181 15717 | 14795 14866 15200 15736 | 921 |
| 546846 | n/a | n/a | CTGTCCTATATCACTGTCCT | 5-10-5 | 95 | 14777 14848 15182 15718 | 14796 14867 15201 15737 | 922 |
| 546847 | n/a | n/a | ACTGTCCTATATCACTGTCC | 5-10-5 | 88 | 14778 14849 15183 15719 | 14797 14868 15202 15738 | 923 |
| 546848 | n/a | n/a | TCACTGTCCTATATCACTGT | 5-10-5 | 86 | 14780 14851 14976 15185 15257 15382 15520 15650 15721 15852 15982 | 14799 14870 14995 15204 15276 15401 15539 15669 15740 15871 16001 | 924 |
| 547558 | n/a | n/a | CCCCCAGTTCCCATGCAAGG | 5-10-5 | 52 | 6640 | 6659 | 925 |
| 547559 | n/a | n/a | GAGCACAGATCTCTTCAAGT | 5-10-5 | 69 | 6822 | 6841 | 926 |
| 547560 | n/a | n/a | GACGGTCACCCAGCCCTGAC | 5-10-5 | 42 | 7459 | 7478 | 927 |
| 547561 | n/a | n/a | AAGGGAAATTAGAGGCAGGC | 5-10-5 | 57 | 7583 | 7602 | 928 |
| 547562 | n/a | n/a | CTTTCTTGAGACAATCCCTT | 5-10-5 | 59 | 8463 | 8482 | 929 |
| 547563 | n/a | n/a | GTGGGATCAGAGAATGACTA | 5-10-5 | 48 | 9267 | 9286 | 930 |
| 547564 | n/a | n/a | CCCTCTGTCTTAGATGTCCA | 5-10-5 | 94 | 9390 | 9409 | 931 |
| 547565 | n/a | n/a | CTTATCAGTCCCAGTCATGT | 5-10-5 | 63 | 10698 | 10717 | 932 |
| 547566 | n/a | n/a | AAGAGTTGGGATGCGACTCT | 5-10-5 | 76 | 11335 | 11354 | 933 |
| 547567 | n/a | n/a | TCCACTCCTAAGAAGTATGG | 5-10-5 | 60 | 11546 | 11565 | 934 |

TABLE 13-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 547568 | n/a | n/a | GCACCCTTTTCATTGAGATT | 5-10-5 | 70 | 12070 | 12089 | 935 |
| 547569 | n/a | n/a | ACTACCATTTGGGTTGGTAG | 5-10-5 | 9 | 12571 | 12590 | 936 |
| 547570 | n/a | n/a | AAGCCCTGTTTGGTTTTTAG | 5-10-5 | 18 | 12900 | 12919 | 937 |
| 547571 | n/a | n/a | AAATGACACCAAAATTGAGT | 5-10-5 | 14 | 13744 | 13763 | 938 |
| 547572 | n/a | n/a | AAATGACACCAAAATTCGCT | 5-10-5 | 40 | 13840 | 13859 | 939 |
| 547573 | n/a | n/a | TAAGCAAGGCCTATGTGTGG | 5-10-5 | 2 | 13880 | 13899 | 940 |
| 547574 | n/a | n/a | ACACGCACAGGTCCCAGGGC | 5-10-5 | 51 | 14314 | 14333 | 941 |
| 547575 | n/a | n/a | GGGAAACTCTTTCCTCGCCC | 5-10-5 | 89 | 14583 | 14602 | 942 |
| 547576 | n/a | n/a | CTAGTTTCCTATAACTGCTG | 5-10-5 | 29 | 14734 | 14753 | 943 |
| 547577 | n/a | n/a | CTAACAGTATCACTGTACTA | 5-10-5 | 79 | 14751 14822 14893 15012 15084 15227 15299 15418 15490 15620 15822 15952 | 14770 14841 14912 15031 15103 15246 15318 15437 15509 15639 15841 15971 | 944 |
| 547578 | n/a | n/a | GTCCTATAACTCTAACAGTA | 5-10-5 | 30 | 14762 14833 | 14781 14852 | 945 |
| 547579 | n/a | n/a | TGTCCTATAACTCTAACAGT | 5-10-5 | 0 | 14763 14834 | 14782 14853 | 946 |
| 547580 | n/a | n/a | ATCACTGTCCTATAACTCTA | 5-10-5 | 61 | 14768 14839 | 14787 14858 | 947 |
| 547581 | n/a | n/a | ATATCACTGTCCTATAACTC | 5-10-5 | 60 | 14770 14841 | 14789 14860 | 948 |
| 547582 | n/a | n/a | TATATCACTGTCCTATAACT | 5-10-5 | 22 | 14771 14842 15176 15712 16160 | 14790 14861 15195 15731 16179 | 949 |
| 547583 | n/a | n/a | CACTGTCCTATATCACTGTC | 5-10-5 | 80 | 14779 14850 15184 15720 | 14798 14869 15203 15739 | 950 |

TABLE 14

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 531231 | n/a | n/a | TATCACTGTACTAGTTTCCT | 5-10-5 | 85 | 14744 14815 14886 14945 15005 15077 15220 | 14763 14834 14905 14964 15024 15096 15239 | 334 |

141

TABLE 14-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| | | | | | | 15292 | 15311 | |
| | | | | | | 15351 | 15370 | |
| | | | | | | 15411 | 15430 | |
| | | | | | | 15483 | 15502 | |
| | | | | | | 15555 | 15574 | |
| | | | | | | 15613 | 15632 | |
| | | | | | | 15685 | 15704 | |
| | | | | | | 15815 | 15834 | |
| | | | | | | 15887 | 15906 | |
| | | | | | | 15945 | 15964 | |
| 546849 | n/a | n/a | ATCACTGTCCTATATCACTG | 5-10-5 | 93 | 14781 | 14800 | 951 |
| | | | | | | 14852 | 14871 | |
| | | | | | | 14977 | 14996 | |
| | | | | | | 15186 | 15205 | |
| | | | | | | 15258 | 15277 | |
| | | | | | | 15383 | 15402 | |
| | | | | | | 15521 | 15540 | |
| | | | | | | 15651 | 15670 | |
| | | | | | | 15722 | 15741 | |
| | | | | | | 15853 | 15872 | |
| | | | | | | 15983 | 16002 | |
| 546850 | n/a | n/a | TATCACTGTCCTATATCACT | 5-10-5 | 80 | 14782 | 14801 | 952 |
| | | | | | | 14853 | 14872 | |
| | | | | | | 14978 | 14997 | |
| | | | | | | 15116 | 15135 | |
| | | | | | | 15187 | 15206 | |
| | | | | | | 15259 | 15278 | |
| | | | | | | 15384 | 15403 | |
| | | | | | | 15522 | 15541 | |
| | | | | | | 15652 | 15671 | |
| | | | | | | 15723 | 15742 | |
| | | | | | | 15854 | 15873 | |
| | | | | | | 15984 | 16003 | |
| 546851 | n/a | n/a | AGTATCACTGTCCTATATCA | 5-10-5 | 81 | 14784 | 14803 | 953 |
| | | | | | | 14980 | 14999 | |
| | | | | | | 15118 | 15137 | |
| | | | | | | 15386 | 15405 | |
| | | | | | | 15524 | 15543 | |
| | | | | | | 15986 | 16005 | |
| 546852 | n/a | n/a | CAGTATCACTGTCCTATATC | 5-10-5 | 94 | 14785 | 14804 | 954 |
| | | | | | | 14981 | 15000 | |
| | | | | | | 15119 | 15138 | |
| | | | | | | 15387 | 15406 | |
| | | | | | | 15525 | 15544 | |
| | | | | | | 15987 | 16006 | |
| 546853 | n/a | n/a | ACAGTATCACTGTCCTATAT | 5-10-5 | 86 | 14786 | 14805 | 955 |
| | | | | | | 14982 | 15001 | |
| | | | | | | 15120 | 15139 | |
| | | | | | | 15388 | 15407 | |
| | | | | | | 15526 | 15545 | |
| | | | | | | 15988 | 16007 | |
| 546854 | n/a | n/a | TAACAGTATCACTGTCCTAT | 5-10-5 | 90 | 14788 | 14807 | 956 |
| | | | | | | 14984 | 15003 | |
| | | | | | | 15050 | 15069 | |
| | | | | | | 15122 | 15141 | |
| | | | | | | 15390 | 15409 | |
| | | | | | | 15456 | 15475 | |
| | | | | | | 15528 | 15547 | |
| | | | | | | 15990 | 16009 | |
| 546855 | n/a | n/a | ATAACAGTATCACTGTCCTA | 5-10-5 | 87 | 14789 | 14808 | 957 |
| | | | | | | 14985 | 15004 | |
| | | | | | | 15051 | 15070 | |
| | | | | | | 15123 | 15142 | |
| | | | | | | 15391 | 15410 | |

TABLE 14-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| | | | | | | 15457 | 15476 | |
| | | | | | | 15529 | 15548 | |
| | | | | | | 15991 | 16010 | |
| 546856 | n/a | n/a | AACTATAACAGTATCACTGT | 5-10-5 | 54 | 14793 | 14812 | 958 |
| | | | | | | 15055 | 15074 | |
| | | | | | | 15127 | 15146 | |
| | | | | | | 15160 | 15179 | |
| | | | | | | 15461 | 15480 | |
| | | | | | | 15533 | 15552 | |
| | | | | | | 15566 | 15585 | |
| | | | | | | 15696 | 15715 | |
| | | | | | | 15898 | 15917 | |
| | | | | | | 15995 | 16014 | |
| 546857 | n/a | n/a | TATAACTATAACAGTATCAC | 5-10-5 | 7 | 14796 | 14815 | 959 |
| | | | | | | 15058 | 15077 | |
| | | | | | | 15130 | 15149 | |
| | | | | | | 15163 | 15182 | |
| | | | | | | 15464 | 15483 | |
| | | | | | | 15536 | 15555 | |
| | | | | | | 15569 | 15588 | |
| | | | | | | 15699 | 15718 | |
| | | | | | | 15770 | 15789 | |
| | | | | | | 15998 | 16017 | |
| 546858 | n/a | n/a | CTATAACTATAACAGTATCA | 5-10-5 | 21 | 14797 | 14816 | 960 |
| | | | | | | 15059 | 15078 | |
| | | | | | | 15131 | 15150 | |
| | | | | | | 15164 | 15183 | |
| | | | | | | 15465 | 15484 | |
| | | | | | | 15537 | 15556 | |
| | | | | | | 15570 | 15589 | |
| | | | | | | 15700 | 15719 | |
| | | | | | | 15771 | 15790 | |
| | | | | | | 15999 | 16018 | |
| 546859 | n/a | n/a | TTTCCTATAACTATAACAGT | 5-10-5 | 7 | 14801 | 14820 | 961 |
| | | | | | | 15063 | 15082 | |
| | | | | | | 15469 | 15488 | |
| | | | | | | 15541 | 15560 | |
| 546860 | n/a | n/a | CTAGTTTCCTATAACTATAA | 5-10-5 | 36 | 14805 | 14824 | 962 |
| | | | | | | 14876 | 14895 | |
| | | | | | | 14935 | 14954 | |
| | | | | | | 15067 | 15086 | |
| | | | | | | 15210 | 15229 | |
| | | | | | | 15282 | 15301 | |
| | | | | | | 15341 | 15360 | |
| | | | | | | 15473 | 15492 | |
| | | | | | | 15545 | 15564 | |
| | | | | | | 15603 | 15622 | |
| | | | | | | 15675 | 15694 | |
| | | | | | | 15746 | 15765 | |
| | | | | | | 15805 | 15824 | |
| | | | | | | 15877 | 15896 | |
| | | | | | | 15935 | 15954 | |
| 546861 | n/a | n/a | TAACAATATCACTGTCCTAT | 5-10-5 | 68 | 14859 | 14878 | 963 |
| | | | | | | 15193 | 15212 | |
| | | | | | | 15265 | 15284 | |
| | | | | | | 15586 | 15605 | |
| | | | | | | 15658 | 15677 | |
| | | | | | | 15729 | 15748 | |
| | | | | | | 15860 | 15879 | |
| | | | | | | 16086 | 16105 | |
| | | | | | | 16183 | 16202 | |
| | | | | | | 16234 | 16253 | |
| 546862 | n/a | n/a | AACTATAACAATATCACTGT | 5-10-5 | 0 | 14864 | 14883 | 964 |
| | | | | | | 14923 | 14942 | |
| | | | | | | 15198 | 15217 | |
| | | | | | | 15270 | 15289 | |

TABLE 14-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| | | | | | | 15329 | 15348 | |
| | | | | | | 15591 | 15610 | |
| | | | | | | 15663 | 15682 | |
| | | | | | | 15734 | 15753 | |
| | | | | | | 15793 | 15812 | |
| | | | | | | 15865 | 15884 | |
| | | | | | | 15923 | 15942 | |
| | | | | | | 16066 | 16085 | |
| | | | | | | 16091 | 16110 | |
| | | | | | | 16144 | 16163 | |
| | | | | | | 16239 | 16258 | |
| 546863 | n/a | n/a | TAACTATAACAATATCACTG | 5-10-5 | 21 | 14865 | 14884 | 965 |
| | | | | | | 14924 | 14943 | |
| | | | | | | 15199 | 15218 | |
| | | | | | | 15271 | 15290 | |
| | | | | | | 15330 | 15349 | |
| | | | | | | 15592 | 15611 | |
| | | | | | | 15664 | 15683 | |
| | | | | | | 15735 | 15754 | |
| | | | | | | 15794 | 15813 | |
| | | | | | | 15866 | 15885 | |
| | | | | | | 15924 | 15943 | |
| | | | | | | 16067 | 16086 | |
| | | | | | | 16092 | 16111 | |
| | | | | | | 16145 | 16164 | |
| | | | | | | 16240 | 16259 | |
| 546864 | n/a | n/a | ATAACTATAACAATATCACT | 5-10-5 | 0 | 14866 | 14885 | 966 |
| | | | | | | 14925 | 14944 | |
| | | | | | | 15200 | 15219 | |
| | | | | | | 15272 | 15291 | |
| | | | | | | 15331 | 15350 | |
| | | | | | | 15593 | 15612 | |
| | | | | | | 15665 | 15684 | |
| | | | | | | 15736 | 15755 | |
| | | | | | | 15795 | 15814 | |
| | | | | | | 15867 | 15886 | |
| | | | | | | 15925 | 15944 | |
| | | | | | | 16068 | 16087 | |
| | | | | | | 16093 | 16112 | |
| | | | | | | 16146 | 16165 | |
| | | | | | | 16241 | 16260 | |
| 546865 | n/a | n/a | TATAACTATAACAATATCAC | 5-10-5 | 0 | 14867 | 14886 | 967 |
| | | | | | | 14926 | 14945 | |
| | | | | | | 15201 | 15220 | |
| | | | | | | 15273 | 15292 | |
| | | | | | | 15332 | 15351 | |
| | | | | | | 15594 | 15613 | |
| | | | | | | 15666 | 15685 | |
| | | | | | | 15737 | 15756 | |
| | | | | | | 15796 | 15815 | |
| | | | | | | 15868 | 15887 | |
| | | | | | | 15926 | 15945 | |
| | | | | | | 16069 | 16088 | |
| | | | | | | 16094 | 16113 | |
| | | | | | | 16147 | 16166 | |
| | | | | | | 16242 | 16261 | |
| 546866 | n/a | n/a | GTTTCCTATAACTATAACAA | 5-10-5 | 35 | 14873 | 14892 | 968 |
| | | | | | | 14932 | 14951 | |
| | | | | | | 15207 | 15226 | |
| | | | | | | 15279 | 15298 | |
| | | | | | | 15338 | 15357 | |
| | | | | | | 15600 | 15619 | |
| | | | | | | 15672 | 15691 | |
| | | | | | | 15743 | 15762 | |
| | | | | | | 15802 | 15821 | |
| | | | | | | 15874 | 15893 | |
| | | | | | | 15932 | 15951 | |

TABLE 14-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 546867 | n/a | n/a | ACCTATAACTCTAACAGTAT | 5-10-5 | 40 | 14903 15022 15094 15237 15309 15428 15500 15630 15832 15962 | 14922 15041 15113 15256 15328 15447 15519 15649 15851 15981 | 969 |
| 546868 | n/a | n/a | TACCTATAACTCTAACAGTA | 5-10-5 | 51 | 14904 15023 15095 15238 15310 15429 15501 15631 15833 15963 | 14923 15042 15114 15257 15329 15448 15520 15650 15852 15982 | 970 |
| 546869 | n/a | n/a | TGTACCTATAACTCTAACAG | 5-10-5 | 53 | 14906 15025 15240 15312 15431 15503 15633 15835 15965 | 14925 15044 15259 15331 15450 15522 15652 15854 15984 | 971 |
| 546870 | n/a | n/a | CTGTACCTATAACTCTAACA | 5-10-5 | 87 | 14907 15026 15241 15313 15432 15504 15634 15836 15966 | 14926 15045 15260 15332 15451 15523 15653 15855 15985 | 972 |
| 546871 | n/a | n/a | ACTGTACCTATAACTCTAAC | 5-10-5 | 73 | 14908 15027 15242 15314 15433 15505 15635 15837 15967 | 14927 15046 15261 15333 15452 15524 15654 15856 15986 | 973 |
| 546872 | n/a | n/a | CACTGTACCTATAACTCTAA | 5-10-5 | 87 | 14909 15028 15243 15315 15434 15506 15636 15838 15968 | 14928 15047 15262 15334 15453 15525 15655 15857 15987 | 974 |
| 546873 | n/a | n/a | CAATATCACTGTACCTATAA | 5-10-5 | 34 | 14915 15321 15785 | 14934 15340 15804 | 975 |
| 546874 | n/a | n/a | ATAACAATATCACTGTACCT | 5-10-5 | 68 | 14919 15325 15789 16062 16140 | 14938 15344 15808 16081 16159 | 976 |

TABLE 14-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 546875 | n/a | n/a | ACTATAACAATATCACTGTA | 5-10-5 | 33 | 14922<br>15328<br>15792<br>16065<br>16143 | 14941<br>15347<br>15811<br>16084<br>16162 | 977 |
| 546876 | n/a | n/a | GTCCTATATCACTGTACCTG | 5-10-5 | 87 | 14971 | 14990 | 978 |
| 546877 | n/a | n/a | CACTGTCCTATATCACTGTA | 5-10-5 | 88 | 14975<br>15256<br>15381<br>15519<br>15649<br>15851<br>15981 | 14994<br>15275<br>15400<br>15538<br>15668<br>15870<br>16000 | 979 |
| 546878 | n/a | n/a | CCTATAACAGTATCACTGTC | 5-10-5 | 81 | 14988<br>15394 | 15007<br>15413 | 980 |
| 546879 | n/a | n/a | TTTCCTATAACAGTATCACT | 5-10-5 | 42 | 14991<br>15397 | 15010<br>15416 | 981 |
| 546880 | n/a | n/a | GTTTCCTATAACAGTATCAC | 5-10-5 | 41 | 14992<br>15398 | 15011<br>15417 | 982 |
| 546881 | n/a | n/a | AGTTTCCTATAACAGTATCA | 5-10-5 | 49 | 14993<br>15399 | 15012<br>15418 | 983 |
| 546882 | n/a | n/a | TAGTTTCCTATAACAGTATC | 5-10-5 | 24 | 14994<br>15400 | 15013<br>15419 | 984 |
| 546883 | n/a | n/a | CTAGTTTCCTATAACAGTAT | 5-10-5 | 19 | 14995<br>15401 | 15014<br>15420 | 985 |
| 546884 | n/a | n/a | ACTAGTTTCCTATAACAGTA | 5-10-5 | 6 | 14996<br>15402 | 15015<br>15421 | 986 |
| 547584 | n/a | n/a | GTATCACTGTCCTATATCAC | 5-10-5 | 85 | 14783<br>14979<br>15117<br>15385<br>15523<br>15985 | 14802<br>14998<br>15136<br>15404<br>15542<br>16004 | 987 |
| 547585 | n/a | n/a | AACAGTATCACTGTCCTATA | 5-10-5 | 85 | 14787<br>14983<br>15121<br>15389<br>15527<br>15989 | 14806<br>15002<br>15140<br>15408<br>15546<br>16008 | 988 |
| 547586 | n/a | n/a | TATAACAGTATCACTGTCCT | 5-10-5 | 82 | 14790<br>14986<br>15052<br>15124<br>15392<br>15458<br>15530<br>15992 | 14809<br>15005<br>15071<br>15143<br>15411<br>15477<br>15549<br>16011 | 989 |
| 547587 | n/a | n/a | CTATAACAGTATCACTGTCC | 5-10-5 | 96 | 14791<br>14987<br>15053<br>15125<br>15393<br>15459<br>15531<br>15993 | 14810<br>15006<br>15072<br>15144<br>15412<br>15478<br>15550<br>16012 | 990 |
| 547588 | n/a | n/a | ACTATAACAGTATCACTGTC | 5-10-5 | 83 | 14792<br>15054<br>15126<br>15460 | 14811<br>15073<br>15145<br>15479 | 991 |

TABLE 14-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| | | | | | | 15532 | 15551 | |
| | | | | | | 15994 | 16013 | |
| 547589 | n/a | n/a | TAACTATAACAGTATCACTG | 5-10-5 | 36 | 14794 | 14813 | 992 |
| | | | | | | 15056 | 15075 | |
| | | | | | | 15128 | 15147 | |
| | | | | | | 15161 | 15180 | |
| | | | | | | 15462 | 15481 | |
| | | | | | | 15534 | 15553 | |
| | | | | | | 15567 | 15586 | |
| | | | | | | 15697 | 15716 | |
| | | | | | | 15996 | 16015 | |
| 547590 | n/a | n/a | ATAACTATAACAGTATCACT | 5-10-5 | 0 | 14795 | 14814 | 993 |
| | | | | | | 15057 | 15076 | |
| | | | | | | 15129 | 15148 | |
| | | | | | | 15162 | 15181 | |
| | | | | | | 15463 | 15482 | |
| | | | | | | 15535 | 15554 | |
| | | | | | | 15568 | 15587 | |
| | | | | | | 15698 | 15717 | |
| | | | | | | 15997 | 16016 | |
| 547591 | n/a | n/a | CCTATAACTATAACAGTATC | 5-10-5 | 23 | 14798 | 14817 | 994 |
| | | | | | | 15060 | 15079 | |
| | | | | | | 15165 | 15184 | |
| | | | | | | 15466 | 15485 | |
| | | | | | | 15538 | 15557 | |
| | | | | | | 15571 | 15590 | |
| | | | | | | 15701 | 15720 | |
| | | | | | | 15772 | 15791 | |
| | | | | | | 16000 | 16019 | |
| 547592 | n/a | n/a | TCCTATAACTATAACAGTAT | 5-10-5 | 27 | 14799 | 14818 | 995 |
| | | | | | | 15061 | 15080 | |
| | | | | | | 15166 | 15185 | |
| | | | | | | 15467 | 15486 | |
| | | | | | | 15539 | 15558 | |
| | | | | | | 15572 | 15591 | |
| | | | | | | 15702 | 15721 | |
| | | | | | | 16001 | 16020 | |
| 547593 | n/a | n/a | TTCCTATAACTATAACAGTA | 5-10-5 | 29 | 14800 | 14819 | 996 |
| | | | | | | 15062 | 15081 | |
| | | | | | | 15468 | 15487 | |
| | | | | | | 15540 | 15559 | |
| 547594 | n/a | n/a | GTTTCCTATAACTATAACAG | 5-10-5 | 19 | 14802 | 14821 | 997 |
| | | | | | | 15064 | 15083 | |
| | | | | | | 15470 | 15489 | |
| | | | | | | 15542 | 15561 | |
| 547595 | n/a | n/a | ACTAGTTTCCTATAACTATA | 5-10-5 | 21 | 14806 | 14825 | 998 |
| | | | | | | 14877 | 14896 | |
| | | | | | | 14936 | 14955 | |
| | | | | | | 15068 | 15087 | |
| | | | | | | 15211 | 15230 | |
| | | | | | | 15283 | 15302 | |
| | | | | | | 15342 | 15361 | |
| | | | | | | 15474 | 15493 | |
| | | | | | | 15546 | 15565 | |
| | | | | | | 15604 | 15623 | |
| | | | | | | 15676 | 15695 | |
| | | | | | | 15747 | 15766 | |
| | | | | | | 15806 | 15825 | |
| | | | | | | 15878 | 15897 | |
| | | | | | | 15936 | 15955 | |
| 547596 | n/a | n/a | TACTAGTTTCCTATAACTAT | 5-10-5 | 14 | 14807 | 14826 | 999 |
| | | | | | | 14878 | 14897 | |
| | | | | | | 14937 | 14956 | |
| | | | | | | 15069 | 15088 | |
| | | | | | | 15212 | 15231 | |

TABLE 14-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| | | | | | | 15284 | 15303 | |
| | | | | | | 15343 | 15362 | |
| | | | | | | 15475 | 15494 | |
| | | | | | | 15547 | 15566 | |
| | | | | | | 15605 | 15624 | |
| | | | | | | 15677 | 15696 | |
| | | | | | | 15748 | 15767 | |
| | | | | | | 15807 | 15826 | |
| | | | | | | 15879 | 15898 | |
| | | | | | | 15937 | 15956 | |
| 547597 | n/a | n/a | CAATATCACTGTCCTATATC | 5-10-5 | 29 | 14856 | 14875 | 1000 |
| | | | | | | 15190 | 15209 | |
| | | | | | | 15262 | 15281 | |
| | | | | | | 15655 | 15674 | |
| | | | | | | 15726 | 15745 | |
| | | | | | | 15857 | 15876 | |
| 547598 | n/a | n/a | ACTATAACAATATCACTGTC | 5-10-5 | 59 | 14863 | 14882 | 1001 |
| | | | | | | 15197 | 15216 | |
| | | | | | | 15269 | 15288 | |
| | | | | | | 15590 | 15609 | |
| | | | | | | 15662 | 15681 | |
| | | | | | | 15733 | 15752 | |
| | | | | | | 15864 | 15883 | |
| | | | | | | 15922 | 15941 | |
| | | | | | | 16090 | 16109 | |
| | | | | | | 16238 | 16257 | |
| 547599 | n/a | n/a | TTCCTATAACTATAACAATA | 5-10-5 | 4 | 14871 | 14890 | 1002 |
| | | | | | | 14930 | 14949 | |
| | | | | | | 15205 | 15224 | |
| | | | | | | 15277 | 15296 | |
| | | | | | | 15336 | 15355 | |
| | | | | | | 15598 | 15617 | |
| | | | | | | 15670 | 15689 | |
| | | | | | | 15741 | 15760 | |
| | | | | | | 15800 | 15819 | |
| | | | | | | 15872 | 15891 | |
| | | | | | | 15930 | 15949 | |
| 547600 | n/a | n/a | TTTCCTATAACTATAACAAT | 5-10-5 | 26 | 14872 | 14891 | 1003 |
| | | | | | | 14931 | 14950 | |
| | | | | | | 15206 | 15225 | |
| | | | | | | 15278 | 15297 | |
| | | | | | | 15337 | 15356 | |
| | | | | | | 15599 | 15618 | |
| | | | | | | 15671 | 15690 | |
| | | | | | | 15742 | 15761 | |
| | | | | | | 15801 | 15820 | |
| | | | | | | 15873 | 15892 | |
| | | | | | | 15931 | 15950 | |
| 547601 | n/a | n/a | GTACCTATAACTCTAACAGT | 5-10-5 | 75 | 14905 | 14924 | 1004 |
| | | | | | | 15024 | 15043 | |
| | | | | | | 15239 | 15258 | |
| | | | | | | 15311 | 15330 | |
| | | | | | | 15430 | 15449 | |
| | | | | | | 15502 | 15521 | |
| | | | | | | 15632 | 15651 | |
| | | | | | | 15834 | 15853 | |
| | | | | | | 15964 | 15983 | |
| 547602 | n/a | n/a | TCACTGTACCTATAACTCTA | 5-10-5 | 93 | 14910 | 14929 | 1005 |
| | | | | | | 15029 | 15048 | |
| | | | | | | 15244 | 15263 | |
| | | | | | | 15316 | 15335 | |
| | | | | | | 15435 | 15454 | |
| | | | | | | 15507 | 15526 | |
| | | | | | | 15637 | 15656 | |
| | | | | | | 15839 | 15858 | |
| | | | | | | 15969 | 15988 | |

TABLE 14-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 547603 | n/a | n/a | TATCACTGTACCTATAACTC | 5-10-5 | 41 | 14912 14931 1006<br>15246 15265<br>15318 15337<br>15509 15528<br>15639 15658<br>15841 15860<br>15971 15990 | | |
| 547604 | n/a | n/a | ATATCACTGTACCTATAACT | 5-10-5 | 0 | 14913 14932 1007<br>15247 15266<br>15319 15338<br>15510 15529<br>15640 15659<br>15783 15802<br>15842 15861<br>15972 15991 | | |
| 547605 | n/a | n/a | ACAATATCACTGTACCTATA | 5-10-5 | 43 | 14916 14935 1008<br>15322 15341<br>15786 15805<br>16137 16156 | | |
| 547606 | n/a | n/a | AACAATATCACTGTACCTAT | 5-10-5 | 43 | 14917 14936 1009<br>15323 15342<br>15787 15806<br>16138 16157 | | |
| 547607 | n/a | n/a | TAACAATATCACTGTACCTA | 5-10-5 | 49 | 14918 14937 1010<br>15324 15343<br>15788 15807<br>16139 16158 | | |
| 547608 | n/a | n/a | TATAACAATATCACTGTACC | 5-10-5 | 35 | 14920 14939 1011<br>15326 15345<br>15790 15809<br>16063 16082<br>16141 16160 | | |
| 547609 | n/a | n/a | CTATAACAATATCACTGTAC | 5-10-5 | 23 | 14921 14940 1012<br>15327 15346<br>15791 15810<br>16064 16083<br>16142 16161 | | |
| 547610 | n/a | n/a | TGTAACAGTATCACTGTACT | 5-10-5 | 45 | 14953 14972 1013 | | |
| 547611 | n/a | n/a | CTGTAACAGTATCACTGTAC | 5-10-5 | 71 | 14954 14973 1014 | | |
| 547612 | n/a | n/a | CCTGTAACAGTATCACTGTA | 5-10-5 | 68 | 14955 14974 1015 | | |
| 547613 | n/a | n/a | CTATATCACTGTACCTGTAA | 5-10-5 | 39 | 14968 14987 1016 | | |
| 547614 | n/a | n/a | CCTATATCACTGTACCTGTA | 5-10-5 | 81 | 14969 14988 1017 | | |
| 547615 | n/a | n/a | TCCTATATCACTGTACCTGT | 5-10-5 | 84 | 14970 14989 1018 | | |
| 547616 | n/a | n/a | TGTCCTATATCACTGTACCT | 5-10-5 | 86 | 14972 14991 1019<br>15253 15272<br>15378 15397<br>15516 15535<br>15646 15665<br>15848 15867<br>15978 15997 | | |
| 547617 | n/a | n/a | CTGTCCTATATCACTGTACC | 5-10-5 | 91 | 14973 14992 1020<br>15254 15273<br>15379 15398<br>15517 15536<br>15647 15666<br>15849 15868<br>15979 15998 | | |

TABLE 14-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 547618 | n/a | n/a | ACTGTCCTATATCACTGTAC | 5-10-5 | 87 | 14974<br>15255<br>15380<br>15518<br>15648<br>15850<br>15980 | 14993<br>15274<br>15399<br>15537<br>15667<br>15869<br>15999 | 1021 |
| 547619 | n/a | n/a | TCCTATAACAGTATCACTGT | 5-10-5 | 70 | 14989<br>15395 | 15008<br>15414 | 1022 |
| 547620 | n/a | n/a | TTCCTATAACAGTATCACTG | 5-10-5 | 65 | 14990<br>15396 | 15009<br>15415 | 1023 |
| 547621 | n/a | n/a | TACTAGTTTCCTATAACAGT | 5-10-5 | 12 | 14997<br>15403 | 15016<br>15422 | 1024 |
| 547622 | n/a | n/a | GTCACTGTACCTATAACTCT | 5-10-5 | 88 | 15030<br>15436 | 15049<br>15455 | 1025 |
| 547623 | n/a | n/a | TGTCACTGTACCTATAACTC | 5-10-5 | 81 | 15031<br>15437 | 15050<br>15456 | 1026 |
| 547624 | n/a | n/a | ATGTCACTGTACCTATAACT | 5-10-5 | 64 | 15032<br>15438 | 15051<br>15457 | 1027 |

TABLE 15

| ISIS NO | SEQ ID NO: 1 Start Site | SEQ ID NO: 1 Stop Site | Sequence | % inhibition | Motif | SEQ ID NO: 10 Start Site | SEQ ID NO: 10 Stop Site | SEQ ID NO |
|---|---|---|---|---|---|---|---|---|
| 531231 | n/a | n/a | TATCACTGTACTAGTTTCCT | 93 | 5-10-5 | 14744<br>14815<br>14886<br>14945<br>15005<br>15077<br>15220<br>15292<br>15351<br>15411<br>15483<br>15555<br>15613<br>15685<br>15815<br>15887<br>15945 | 14763<br>14834<br>14905<br>14964<br>15024<br>15096<br>15239<br>15311<br>15370<br>15430<br>15502<br>15574<br>15632<br>15704<br>15834<br>15906<br>15964 | 334 |
| 546885 | n/a | n/a | TATGTCACTGTACCTATAAC | 46 | 5-10-5 | 15033<br>15439 | 15052<br>15458 | 1028 |
| 546886 | n/a | n/a | CTATGTCACTGTACCTATAA | 80 | 5-10-5 | 15034<br>15440 | 15053<br>15459 | 1029 |
| 546887 | n/a | n/a | CCTATGTCACTGTACCTATA | 82 | 5-10-5 | 15035<br>15441 | 15054<br>15460 | 1030 |
| 546888 | n/a | n/a | TCCTATGTCACTGTACCTAT | 78 | 5-10-5 | 15036<br>15442 | 15055<br>15461 | 1031 |
| 546889 | n/a | n/a | GTCCTATGTCACTGTACCTA | 93 | 5-10-5 | 15037<br>15443 | 15056<br>15462 | 1032 |

TABLE 15-continued

| ISIS NO | SEQ ID NO: 1 Start Site | SEQ ID NO: 1 Stop Site | Sequence | % inhibition | Motif | SEQ ID NO: 10 Start Site | SEQ ID NO: 10 Stop Site | SEQ ID NO |
|---|---|---|---|---|---|---|---|---|
| 546890 | n/a | n/a | TGTCCTATGTCACTGTACCT | 78 | 5-10-5 | 15038 15444 | 15057 15463 | 1033 |
| 546891 | n/a | n/a | CTGTCCTATGTCACTGTACC | 81 | 5-10-5 | 15039 15445 | 15058 15464 | 1034 |
| 546892 | n/a | n/a | ACTGTCCTATGTCACTGTAC | 82 | 5-10-5 | 15040 15446 | 15059 15465 | 1035 |
| 546893 | n/a | n/a | CACTGTCCTATGTCACTGTA | 70 | 5-10-5 | 15041 15447 | 15060 15466 | 1036 |
| 546894 | n/a | n/a | TCACTGTCCTATGTCACTGT | 91 | 5-10-5 | 15042 15448 | 15061 15467 | 1037 |
| 546895 | n/a | n/a | TATCACTGTCCTATGTCACT | 77 | 5-10-5 | 15044 15450 | 15063 15469 | 1038 |
| 546896 | n/a | n/a | GTATCACTGTCCTATGTCAC | 75 | 5-10-5 | 15045 15451 | 15064 15470 | 1039 |
| 546897 | n/a | n/a | AGTATCACTGTCCTATGTCA | 90 | 5-10-5 | 15046 15452 | 15065 15471 | 1040 |
| 546898 | n/a | n/a | AACAGTATCACTGTCCTATG | 91 | 5-10-5 | 15049 15455 | 15068 15474 | 1041 |
| 546899 | n/a | n/a | CTACCTATAACTCTAACAGT | 27 | 5-10-5 | 15096 | 15115 | 1042 |
| 546901 | n/a | n/a | ACTGTCCTATAACTATAACA | 56 | 5-10-5 | 15170 15576 15706 16005 16076 16101 16154 | 15189 15595 15725 16024 16095 16120 16173 | 1043 |
| 546902 | n/a | n/a | CACTGTCCTATAACTATAAC | 71 | 5-10-5 | 15171 15577 15707 16006 16077 16102 16155 | 15190 15596 15726 16025 16096 16121 16174 | 1044 |
| 546903 | n/a | n/a | CCTATATCACTGTACCTATA | 91 | 5-10-5 | 15250 15375 15513 15643 15845 15975 | 15269 15394 15532 15662 15864 15994 | 1045 |
| 546904 | n/a | n/a | TCCTATATCACTGTACCTAT | 80 | 5-10-5 | 15251 15376 15514 15644 15846 15976 | 15270 15395 15533 15663 15865 15995 | 1046 |
| 546905 | n/a | n/a | TACCTATAACAGTATCACTG | 65 | 5-10-5 | 15363 | 15382 | 1047 |
| 546907 | n/a | n/a | ATAACTATAACAGTATCACC | 37 | 5-10-5 | 15769 | 15788 | 1048 |
| 546908 | n/a | n/a | TCACTGTACCTATAACTATA | 77 | 5-10-5 | 15780 16252 | 15799 16271 | 1049 |
| 546909 | n/a | n/a | AACAATATCACTGTACCTTT | 44 | 5-10-5 | 16060 | 16079 | 1050 |
| 546910 | n/a | n/a | TAACAATATCACTGTACCTT | 82 | 5-10-5 | 16061 | 16080 | 1051 |

TABLE 15-continued

| ISIS NO | SEQ ID NO: 1 Start Site | SEQ ID NO: 1 Stop Site | Sequence | % inhibition | Motif | SEQ ID NO: 10 Start Site | SEQ ID NO: 10 Stop Site | SEQ ID NO |
|---|---|---|---|---|---|---|---|---|
| 546911 | n/a | n/a | GTCCTATAACTATAACAATA | 52 | 5-10-5 | 16073<br>16098<br>16151 | 16092<br>16117<br>16170 | 1052 |
| 547625 | n/a | n/a | CAGTATCACTGTCCTATGTC | 79 | 5-10-5 | 15047<br>15453 | 15066<br>15472 | 1053 |
| 547626 | n/a | n/a | ACAGTATCACTGTCCTATGT | 91 | 5-10-5 | 15048<br>15454 | 15067<br>15473 | 1054 |
| 547627 | n/a | n/a | TCTACCTATAACTCTAACAG | 71 | 5-10-5 | 15097 | 15116 | 1055 |
| 547628 | n/a | n/a | CTCTACCTATAACTCTAACA | 34 | 5-10-5 | 15098 | 15117 | 1056 |
| 547629 | n/a | n/a | ACTCTACCTATAACTCTAAC | 0 | 5-10-5 | 15099 | 15118 | 1057 |
| 547630 | n/a | n/a | ACTGTCCTATATCACTCTAC | 76 | 5-10-5 | 15112 | 15131 | 1058 |
| 547631 | n/a | n/a | CACTGTCCTATATCACTCTA | 85 | 5-10-5 | 15113 | 15132 | 1059 |
| 547632 | n/a | n/a | TCACTGTCCTATATCACTCT | 87 | 5-10-5 | 15114 | 15133 | 1060 |
| 547633 | n/a | n/a | ATCACTGTCCTATATCACTC | 87 | 5-10-5 | 15115 | 15134 | 1061 |
| 547634 | n/a | n/a | ATCACTGTACTAGTTTTCTA | 72 | 5-10-5 | 15148 | 15167 | 1062 |
| 547635 | n/a | n/a | TATCACTGTACTAGTTTTCT | 53 | 5-10-5 | 15149 | 15168 | 1063 |
| 547636 | n/a | n/a | GTATCACTGTACTAGTTTTC | 86 | 5-10-5 | 15150 | 15169 | 1064 |
| 547637 | n/a | n/a | AGTATCACTGTACTAGTTTT | 88 | 5-10-5 | 15151 | 15170 | 1065 |
| 547638 | n/a | n/a | ATAACAGTATCACTGTACTA | 87 | 5-10-5 | 15156<br>15358<br>15562<br>15692<br>15894 | 15175<br>15377<br>15581<br>15711<br>15913 | 1066 |
| 547639 | n/a | n/a | GTCCTATAACTATAACAGTA | 72 | 5-10-5 | 15167<br>15573<br>15703<br>16002 | 15186<br>15592<br>15722<br>16021 | 1067 |
| 547640 | n/a | n/a | TGTCCTATAACTATAACAGT | 13 | 5-10-5 | 15168<br>15574<br>15704<br>16003 | 15187<br>15593<br>15723<br>16022 | 1068 |
| 547641 | n/a | n/a | CTGTCCTATAACTATAACAG | 43 | 5-10-5 | 15169<br>15575<br>15705<br>16004 | 15188<br>15594<br>15724<br>16023 | 1069 |
| 547642 | n/a | n/a | TCACTGTCCTATAACTATAA | 72 | 5-10-5 | 15172<br>15578<br>15708<br>16007<br>16078<br>16103<br>16156 | 15191<br>15597<br>15727<br>16026<br>16097<br>16122<br>16175 | 1070 |
| 547643 | n/a | n/a | ATCACTGTCCTATAACTATA | 72 | 5-10-5 | 15173<br>15579<br>15709<br>16008<br>16079<br>16104<br>16157<br>16176 | 15192<br>15598<br>15728<br>16027<br>16098<br>16123<br>16176<br>16195 | 1071 |
| 547644 | n/a | n/a | TATCACTGTCCTATAACTAT | 51 | 5-10-5 | 15174<br>15580 | 15193<br>15599 | 1072 |

TABLE 15-continued

| ISIS NO | SEQ ID NO: 1 Start Site | SEQ ID NO: 1 Stop Site | Sequence | % inhibition | Motif | SEQ ID NO: 10 Start Site | SEQ ID NO: 10 Stop Site | SEQ ID NO |
|---|---|---|---|---|---|---|---|---|
| | | | | | | 15710 | 15729 | |
| | | | | | | 16009 | 16028 | |
| | | | | | | 16080 | 16099 | |
| | | | | | | 16158 | 16177 | |
| | | | | | | 16177 | 16196 | |
| | | | | | | 16228 | 16247 | |
| 547645 | n/a | n/a | ATATCACTGTCCTATAACTA | 60 | 5-10-5 | 15175 | 15194 | 1073 |
| | | | | | | 15581 | 15600 | |
| | | | | | | 15711 | 15730 | |
| | | | | | | 16010 | 16029 | |
| | | | | | | 16081 | 16100 | |
| | | | | | | 16159 | 16178 | |
| | | | | | | 16178 | 16197 | |
| | | | | | | 16229 | 16248 | |
| 547646 | n/a | n/a | CTATATCACTGTACCTATAA | 23 | 5-10-5 | 15249 | 15268 | 1074 |
| | | | | | | 15374 | 15393 | |
| | | | | | | 15512 | 15531 | |
| | | | | | | 15642 | 15661 | |
| | | | | | | 15844 | 15863 | |
| | | | | | | 15974 | 15993 | |
| 547647 | n/a | n/a | GTCCTATATCACTGTACCTA | 92 | 5-10-5 | 15252 | 15271 | 1075 |
| | | | | | | 15377 | 15396 | |
| | | | | | | 15515 | 15534 | |
| | | | | | | 15645 | 15664 | |
| | | | | | | 15847 | 15866 | |
| | | | | | | 15977 | 15996 | |
| 547648 | n/a | n/a | CCTATAACAGTATCACTGTA | 83 | 5-10-5 | 15361 | 15380 | 1076 |
| 547649 | n/a | n/a | ACCTATAACAGTATCACTGT | 73 | 5-10-5 | 15362 | 15381 | 1077 |
| 547650 | n/a | n/a | GTACCTATAACAGTATCACT | 32 | 5-10-5 | 15364 | 15383 | 1078 |
| 547651 | n/a | n/a | TGTACCTATAACAGTATCAC | 48 | 5-10-5 | 15365 | 15384 | 1079 |
| 547652 | n/a | n/a | TCACTGTACCTATAACAGTA | 59 | 5-10-5 | 15369 | 15388 | 1080 |
| 547653 | n/a | n/a | ATCACTGTACCTATAACAGT | 57 | 5-10-5 | 15370 | 15389 | 1081 |
| 547654 | n/a | n/a | TATCACTGTACCTATAACAG | 53 | 5-10-5 | 15371 | 15390 | 1082 |
| 547655 | n/a | n/a | AATATCACTGTCCTATAACT | 37 | 5-10-5 | 15582 | 15601 | 1083 |
| | | | | | | 16011 | 16030 | |
| | | | | | | 16082 | 16101 | |
| | | | | | | 16179 | 16198 | |
| | | | | | | 16230 | 16249 | |
| 547656 | n/a | n/a | CAATATCACTGTCCTATAAC | 42 | 5-10-5 | 15583 | 15602 | 1084 |
| | | | | | | 16083 | 16102 | |
| | | | | | | 16180 | 16199 | |
| | | | | | | 16231 | 16250 | |
| 547657 | n/a | n/a | ACAATATCACTGTCCTATAA | 43 | 5-10-5 | 15584 | 15603 | 1085 |
| | | | | | | 16084 | 16103 | |
| | | | | | | 16181 | 16200 | |
| | | | | | | 16232 | 16251 | |
| 547658 | n/a | n/a | CGTACTAGTTTCCTATAACT | 68 | 5-10-5 | 15750 | 15769 | 1086 |
| 547659 | n/a | n/a | ACTATAACAGTATCACCGTA | 80 | 5-10-5 | 15766 | 15785 | 1087 |
| 547660 | n/a | n/a | AACTATAACAGTATCACCGT | 68 | 5-10-5 | 15767 | 15786 | 1088 |
| 547661 | n/a | n/a | TAACTATAACAGTATCACCG | 80 | 5-10-5 | 15768 | 15787 | 1089 |
| 547662 | n/a | n/a | ACCTATAACTATAACAGTAT | 0 | 5-10-5 | 15773 | 15792 | 1090 |
| 547663 | n/a | n/a | TACCTATAACTATAACAGTA | 10 | 5-10-5 | 15774 | 15793 | 1091 |
| 547664 | n/a | n/a | GTACCTATAACTATAACAGT | 2 | 5-10-5 | 15775 | 15794 | 1092 |

TABLE 15-continued

| ISIS NO | SEQ ID NO: 1 Start Site | SEQ ID NO: 1 Stop Site | Sequence | % inhibition | Motif | SEQ ID NO: 10 Start Site | SEQ ID NO: 10 Stop Site | SEQ ID NO |
|---|---|---|---|---|---|---|---|---|
| 547665 | n/a | n/a | TGTACCTATAACTATAACAG | 10 | 5-10-5 | 15776 | 15795 | 1093 |
| 547666 | n/a | n/a | ATCACTGTACCTATAACTAT | 71 | 5-10-5 | 15781 15800 | 1094 |
| | | | | | | 16253 | 16272 | |
| 547667 | n/a | n/a | TATCACTGTACCTATAACTA | 55 | 5-10-5 | 15782 | 15801 | 1095 |
| 547668 | n/a | n/a | CAACTATAACAGTATCACTG | 44 | 5-10-5 | 15899 | 15918 | 1096 |
| 547669 | n/a | n/a | ACAACTATAACAGTATCACT | 0 | 5-10-5 | 15900 | 15919 | 1097 |
| 547670 | n/a | n/a | TACAACTATAACAGTATCAC | 0 | 5-10-5 | 15901 | 15920 | 1098 |
| 547671 | n/a | n/a | CTACAACTATAACAGTATCA | 0 | 5-10-5 | 15902 | 15921 | 1099 |
| 547672 | n/a | n/a | CAATATCACTGTCCTACAAC | 36 | 5-10-5 | 15915 | 15934 | 1100 |
| 547673 | n/a | n/a | GAATATCACTGTCCTATAAC | 21 | 5-10-5 | 16012 | 16031 | 1101 |
| 547674 | n/a | n/a | ACAATATCACTGTACCTTTA | 53 | 5-10-5 | 16059 | 16078 | 1102 |
| 547675 | n/a | n/a | TGTCCTATAACTATAACAAT | 10 | 5-10-5 | 16074 | 16093 | 1103 |
| | | | | | | 16099 | 16118 | |
| | | | | | | 16152 | 16171 | |
| 547676 | n/a | n/a | CTGTCCTATAACTATAACAA | 41 | 5-10-5 | 16075 | 16094 | 1104 |
| | | | | | | 16100 | 16119 | |
| | | | | | | 16153 | 16172 | |

TABLE 16

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 531231 | n/a | n/a | TATCACTGTACTAGTTTCCT | 5-10-5 | 93 | 14744 | 14763 | 334 |
| | | | | | | 14815 | 14834 | |
| | | | | | | 14886 | 14905 | |
| | | | | | | 14945 | 14964 | |
| | | | | | | 15005 | 15024 | |
| | | | | | | 15077 | 15096 | |
| | | | | | | 15220 | 15239 | |
| | | | | | | 15292 | 15311 | |
| | | | | | | 15351 | 15370 | |
| | | | | | | 15411 | 15430 | |
| | | | | | | 15483 | 15502 | |
| | | | | | | 15555 | 15574 | |
| | | | | | | 15613 | 15632 | |
| | | | | | | 15685 | 15704 | |
| | | | | | | 15815 | 15834 | |
| | | | | | | 15887 | 15906 | |
| | | | | | | 15945 | 15964 | |
| 546529 | n/a | n/a | GCACCTGGCAGAACAGTACC | 5-10-5 | 65 | 26419 | 26438 | 1105 |
| 546578 | n/a | n/a | GACAGTGGGCCAGAGCCTTG | 5-10-5 | 73 | 26686 | 26705 | 1106 |
| 546912 | n/a | n/a | ACATCACTGTCCTATAACTA | 5-10-5 | 26 | 16106 | 16125 | 1107 |
| 546913 | n/a | n/a | GTACCTATATCACTGTAACT | 5-10-5 | 38 | 16126 | 16145 | 1108 |
| 546914 | n/a | n/a | ATATCACTGTACCTATATCA | 5-10-5 | 52 | 16134 | 16153 | 1109 |
| 546915 | n/a | n/a | TCACTGTCCTATAACTATAT | 5-10-5 | 39 | 16175 | 16194 | 1110 |
| 546916 | n/a | n/a | CGTCACTGTACCTATAACTG | 5-10-5 | 92 | 16203 | 16222 | 1111 |

TABLE 16-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 546917 | n/a | n/a | ATCACTGTCCTATAACTATT | 5-10-5 | 63 | 16227 | 16246 | 1112 |
| 546918 | n/a | n/a | AACATCACTGTACCTATAAC | 5-10-5 | 14 | 16256 | 16275 | 1113 |
| 546926 | n/a | n/a | GCCATCCAGGGTGCTCTCCC | 5-10-5 | 81 | 16839 | 16858 | 1114 |
| 546931 | n/a | n/a | GCCCCCGGAGCACCTTCACT | 5-10-5 | 58 | 17205 | 17224 | 1115 |
| 546935 | n/a | n/a | CGTGGTTAGCCTGACATCTC | 5-10-5 | 86 | 17412 | 17431 | 1116 |
| 546939 | n/a | n/a | GCCATCTGGTTAGCCTCCGA | 5-10-5 | 89 | 17664 | 17683 | 1117 |
| 546942 | n/a | n/a | TACACTGAACCCCCTTAGGC | 5-10-5 | 56 | 18570 | 18589 | 1118 |
| 546943 | n/a | n/a | CAGTTTGGCCTTTCCATCTC | 5-10-5 | 54 | 18819 | 18838 | 1119 |
| 546944 | n/a | n/a | GCCACTAACCCACCTCTTAA | 5-10-5 | 42 | 19140 | 19159 | 1120 |
| 546946 | n/a | n/a | ACTCCCATCTACTCCCCCAT | 5-10-5 | 41 | 19291 | 19310 | 1121 |
| 546954 | n/a | n/a | CTGCTGATTGTGTCTGGCTC | 5-10-5 | 71 | 20235 | 20254 | 1122 |
| 546955 | n/a | n/a | ACAAGGCTTCGAGGACAGCC | 5-10-5 | 49 | 20339 | 20358 | 1123 |
| 546964 | n/a | n/a | GCGATTCCTTGCCTCTGCTG | 5-10-5 | 53 | 21550 | 21569 | 1124 |
| 546967 | n/a | n/a | CACCGCGCGAATGCCTGCCT | 5-10-5 | 93 | 22657 | 22676 | 1125 |
| 546969 | n/a | n/a | ATCCAACCTCTCTCCCTATC | 5-10-5 | 53 | 22901 | 22920 | 1126 |
| 546970 | n/a | n/a | GCCCAAGCCTACATGCATAC | 5-10-5 | 61 | 23426 | 23445 | 1127 |
| 546975 | n/a | n/a | GGCCTGGATACAGCCTTTCT | 5-10-5 | 70 | 23825 | 23844 | 1128 |
| 546977 | n/a | n/a | GTCCCGAAGAGTCAAGTCCA | 5-10-5 | 76 | 24253 | 24272 | 1129 |
| 546979 | n/a | n/a | ACTGTTGTCCATAGCAGCAT | 5-10-5 | 71 | 24504 | 24523 | 1130 |
| 546980 | n/a | n/a | AGCCCTCAATTGTTGCTGGT | 5-10-5 | 79 | 24664 | 24683 | 1131 |
| 546983 | n/a | n/a | GATGACCTGCAGATGCACAG | 5-10-5 | 74 | 24978 | 24997 | 1132 |
| 546986 | n/a | n/a | CAGGATAGAACTGATGGTCC | 5-10-5 | 91 | 25318 | 25337 | 1133 |
| 546990 | n/a | n/a | AGAACAGGAGACAATCCACT | 5-10-5 | 49 | 25680 | 25699 | 1134 |
| 546994 | n/a | n/a | GTTCATGTGGCAACCTGTGA | 5-10-5 | 58 | 26112 | 26131 | 1135 |
| 547677 | n/a | n/a | CATCACTGTCCTATAACTAT | 5-10-5 | 62 | 16105 | 16124 | 1136 |
| 547678 | n/a | n/a | TACCTATATCACTGTAACTA | 5-10-5 | 21 | 16125 | 16144 | 1137 |
| 547679 | n/a | n/a | TGTACCTATATCACTGTAAC | 5-10-5 | 28 | 16127 | 16146 | 1138 |
| 547680 | n/a | n/a | TATCACTGTACCTATATCAC | 5-10-5 | 41 | 16133 | 16152 | 1139 |
| 547681 | n/a | n/a | AATATCACTGTACCTATATC | 5-10-5 | 6 | 16135 | 16154 | 1140 |
| 547682 | n/a | n/a | CAATATCACTGTACCTATAT | 5-10-5 | 20 | 16136 | 16155 | 1141 |
| 547683 | n/a | n/a | ACTATATCACTGTCCTATAA | 5-10-5 | 33 | 16162 | 16181 | 1142 |
| 547684 | n/a | n/a | TAACTATATCACTGTCCTAT | 5-10-5 | 43 | 16164 | 16183 | 1143 |
| 547685 | n/a | n/a | ATAACTATATCACTGTCCTA | 5-10-5 | 35 | 16165 | 16184 | 1144 |
| 547686 | n/a | n/a | CTGTCCTATAACTATATCAC | 5-10-5 | 36 | 16172 | 16191 | 1145 |
| 547687 | n/a | n/a | ACTGTCCTATAACTATATCA | 5-10-5 | 41 | 16173 | 16192 | 1146 |
| 547688 | n/a | n/a | CACTGTCCTATAACTATATC | 5-10-5 | 47 | 16174 | 16193 | 1147 |

TABLE 16-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 547689 | n/a | n/a | GTAACAATATCACTGTCCTA | 5-10-5 | 73 | 16184 | 16203 | 1148 |
| 547690 | n/a | n/a | CTGTAACAATATCACTGTCC | 5-10-5 | 76 | 16186 | 16205 | 1149 |
| 547691 | n/a | n/a | ACTGTAACAATATCACTGTC | 5-10-5 | 36 | 16187 | 16206 | 1150 |
| 547692 | n/a | n/a | CACTGTACCTATAACTGTAA | 5-10-5 | 47 | 16200 | 16219 | 1151 |
| 547693 | n/a | n/a | TCACTGTACCTATAACTGTA | 5-10-5 | 61 | 16201 | 16220 | 1152 |
| 547694 | n/a | n/a | GTCACTGTACCTATAACTGT | 5-10-5 | 92 | 16202 | 16221 | 1153 |
| 547695 | n/a | n/a | ACTGTCCTATAACTATTACA | 5-10-5 | 31 | 16224 | 16243 | 1154 |
| 547696 | n/a | n/a | CACTGTCCTATAACTATTAC | 5-10-5 | 26 | 16225 | 16244 | 1155 |
| 547697 | n/a | n/a | TCACTGTCCTATAACTATTA | 5-10-5 | 63 | 16226 | 16245 | 1156 |
| 547698 | n/a | n/a | ACCTATAACTATAACAATAT | 5-10-5 | 0 | 16245 | 16264 | 1157 |
| 547699 | n/a | n/a | TACCTATAACTATAACAATA | 5-10-5 | 10 | 16246 | 16265 | 1158 |
| 547700 | n/a | n/a | GTACCTATAACTATAACAAT | 5-10-5 | 0 | 16247 | 16266 | 1159 |
| 547701 | n/a | n/a | CATCACTGTACCTATAACTA | 5-10-5 | 49 | 16254 | 16273 | 1160 |
| 547702 | n/a | n/a | ACATCACTGTACCTATAACT | 5-10-5 | 44 | 16255 | 16274 | 1161 |
| 547703 | n/a | n/a | CAACATCACTGTACCTATAA | 5-10-5 | 25 | 16257 | 16276 | 1162 |
| 547704 | n/a | n/a | ACATCTTGTCATTAACATCC | 5-10-5 | 61 | 16435 | 16454 | 1163 |
| 547705 | n/a | n/a | GCACCCAATACAGGGCCAGG | 5-10-5 | 69 | 16512 | 16531 | 1164 |
| 547706 | n/a | n/a | TGCCTCCTGGCAGCCTTCAA | 5-10-5 | 73 | 16694 | 16713 | 1165 |
| 547707 | n/a | n/a | TGAAAAGCCACGCCCTTAGC | 5-10-5 | 32 | 16975 | 16994 | 1166 |
| 547708 | n/a | n/a | GCCAGGAGACAGCCCTACTC | 5-10-5 | 67 | 17055 | 17074 | 1167 |
| 547709 | n/a | n/a | AGCCCAATGTCCTAACCTGT | 5-10-5 | 76 | 17791 | 17810 | 1168 |
| 547710 | n/a | n/a | TGCGGTTATATGGGCTGAAG | 5-10-5 | 85 | 19540 | 19559 | 1169 |
| 547711 | n/a | n/a | CCTTTAGCCACTCCTCTTGC | 5-10-5 | 45 | 20061 | 20080 | 1170 |
| 547712 | n/a | n/a | CCCCATGGTACCAAAGCCAT | 5-10-5 | 79 | 20528 | 20547 | 1171 |
| 547713 | n/a | n/a | CTCAATGCCACCCTTTCCCC | 5-10-5 | 37 | 20880 | 20899 | 1172 |
| 547714 | n/a | n/a | CTGTCTAACTGGCCTGGCTG | 5-10-5 | 19 | 21326 | 21345 | 1173 |
| 547715 | n/a | n/a | GGTCAGAAGGCCTCTTATTC | 5-10-5 | 21 | 21750 | 21769 | 1174 |
| 547716 | n/a | n/a | CCATCTGTCCCCTCAATCCC | 5-10-5 | 9 | 22197 | 22216 | 1175 |
| 547717 | n/a | n/a | ACTCTGGCACTGGTCATGGA | 5-10-5 | 54 | 22761 | 22780 | 1176 |
| 547718 | n/a | n/a | ATAAAGTGCGATTAAGCCCC | 5-10-5 | 86 | 23515 | 23534 | 1177 |
| 547719 | n/a | n/a | TACCAAGCTTGTAGAAGGGA | 5-10-5 | 69 | 23633 | 23652 | 1178 |
| 547720 | n/a | n/a | GAAAGACGGCCAATGGGAAA | 5-10-5 | 8 | 24177 | 24196 | 1179 |
| 547721 | n/a | n/a | CTCTATCAAAATCCTGCTGC | 5-10-5 | 68 | 25527 | 25546 | 1180 |
| 547722 | n/a | n/a | CTCCAGTCACCACCATTGCC | 5-10-5 | 80 | 25860 | 25879 | 1181 |

TABLE 17

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 531231 | n/a | n/a | TATCACTGTACTAGTTTCCT | 5-10-5 | 91 | 14744 | 14763 | 334 |
| | | | | | | 14815 | 14834 | |
| | | | | | | 14886 | 14905 | |
| | | | | | | 14945 | 14964 | |
| | | | | | | 15005 | 15024 | |
| | | | | | | 15077 | 15096 | |
| | | | | | | 15220 | 15239 | |
| | | | | | | 15292 | 15311 | |
| | | | | | | 15351 | 15370 | |
| | | | | | | 15411 | 15430 | |
| | | | | | | 15483 | 15502 | |
| | | | | | | 15555 | 15574 | |
| | | | | | | 15613 | 15632 | |
| | | | | | | 15685 | 15704 | |
| | | | | | | 15815 | 15834 | |
| | | | | | | 15887 | 15906 | |
| | | | | | | 15945 | 15964 | |
| 546599 | n/a | n/a | AAGAGTAAGCCTTCACAGGG | 5-10-5 | 82 | 27583 | 27602 | 1182 |
| 546606 | n/a | n/a | CTCACCAGAGTTGTCCCCAG | 5-10-5 | 0 | 27722 | 27741 | 1183 |
| 546999 | n/a | n/a | GCAGCTCACACCCAAAAAGC | 5-10-5 | 29 | 27004 | 27023 | 1184 |
| 547000 | n/a | n/a | TCTGTTACCTTGAGGATTGT | 5-10-5 | 63 | 27276 | 27295 | 1185 |
| 547006 | n/a | n/a | CGCCATCTGCCCTGTACAGA | 5-10-5 | 39 | 28248 | 28267 | 1186 |
| 547008 | n/a | n/a | TTGGTGGTGGGATTGGTGGT | 5-10-5 | 81 | 28333 | 28352 | 1187 |
| | | | | | | 28388 | 28407 | |
| | | | | | | 28443 | 28462 | |
| | | | | | | 28608 | 28627 | |
| | | | | | | 28620 | 28639 | |
| 547009 | n/a | n/a | AATTGGTGGTGGGATTGGTG | 5-10-5 | 73 | 28335 | 28354 | 1188 |
| 547010 | n/a | n/a | GAATTGGTGGTGGGATTGGT | 5-10-5 | 39 | 28336 | 28355 | 1189 |
| 547011 | n/a | n/a | GGCAGGATTGGTGGTGGAAT | 5-10-5 | 22 | 28352 | 28371 | 1190 |
| 547013 | n/a | n/a | TGAGATTGGTGGTGGGTGGC | 5-10-5 | 0 | 28369 | 28388 | 1191 |
| 547015 | n/a | n/a | GGTGGTGGGATTGGTGCTGA | 5-10-5 | 55 | 28429 | 28448 | 1192 |
| 547016 | n/a | n/a | GTAGGTGGTGGGATTGGTGG | 5-10-5 | 62 | 28456 | 28475 | 1193 |
| | | | | | | 28535 | 28554 | |
| 547017 | n/a | n/a | GGTAGGTGGTGGGATTGGTG | 5-10-5 | 61 | 28457 | 28476 | 1194 |
| | | | | | | 28536 | 28555 | |
| 547018 | n/a | n/a | GGTGGCGGGATTGGTGGTGG | 5-10-5 | 58 | 28477 | 28496 | 1195 |
| | | | | | | 28556 | 28575 | |
| 547019 | n/a | n/a | GATCGGTGGTGGGATTGGTC | 5-10-5 | 83 | 28500 | 28519 | 1196 |
| | | | | | | 28579 | 28598 | |
| 547020 | n/a | n/a | GGATCGGTGGTGGGATTGGT | 5-10-5 | 47 | 28501 | 28520 | 1197 |
| | | | | | | 28580 | 28599 | |
| 547021 | n/a | n/a | TTGGTGGCGGGATCGGTGGT | 5-10-5 | 57 | 28510 | 28529 | 1198 |
| | | | | | | 28589 | 28608 | |
| 547022 | n/a | n/a | ATTGGTGGCGGGATCGGTGG | 5-10-5 | 69 | 28511 | 28530 | 1199 |
| 547023 | n/a | n/a | GATTGGTGGCGGGATCGGTG | 5-10-5 | 91 | 28512 | 28531 | 1200 |
| 547024 | n/a | n/a | GGATTGGTGGCGGGATCGGT | 5-10-5 | 56 | 28513 | 28532 | 1201 |
| 547025 | n/a | n/a | TGGTGGTGGGATTGGTGGTT | 5-10-5 | 72 | 28607 | 28626 | 1202 |
| 547029 | n/a | n/a | TCTTCTAGGGCCACACCTCT | 5-10-5 | 50 | 28891 | 28910 | 1203 |
| 547035 | n/a | n/a | TGGTCCCAAATTGGAGTGCA | 5-10-5 | 40 | 29383 | 29402 | 1204 |

TABLE 17-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 547039 | n/a | n/a | TCTCTATACAGCTGGGCACA | 5-10-5 | 0 | 29997 | 30016 | 1205 |
| 547049 | n/a | n/a | CACTTCCCAGCAACCCTCAC | 5-10-5 | 20 | 30765 | 30784 | 1206 |
| 547055 | n/a | n/a | GCTCCTGGCAGCAATGACCC | 5-10-5 | 70 | 31104 | 31123 | 1207 |
| 547059 | n/a | n/a | GGGTATCTTCACTGTTCCAG | 5-10-5 | 12 | 31540 | 31559 | 1208 |
| 547063 | n/a | n/a | CGTCATGCTTACCTTTCTCC | 5-10-5 | 23 | 31955 | 31974 | 1209 |
| 547069 | n/a | n/a | GCCCTCCGAGCTTTGGCAAC | 5-10-5 | 35 | 32581 | 32600 | 1210 |
| 547071 | n/a | n/a | GCAGCCCCCAGAAATCCCA | 5-10-5 | 27 | 32708 | 32727 | 1211 |
| 547076 | n/a | n/a | TCTCAAGCAGCCTATTGTGT | 5-10-5 | 14 | 33263 | 33282 | 1212 |
| 547080 | n/a | n/a | GTGCAAGACCTTGCTTGCCA | 5-10-5 | 54 | 33657 | 33676 | 1213 |
| 547081 | n/a | n/a | CTGTAGTCCACTACACAGCA | 5-10-5 | 83 | 33801 | 33820 | 1214 |
| 547082 | n/a | n/a | TCTCCCTGAGTCACAGTGGA | 5-10-5 | 64 | 33881 | 33900 | 1215 |
| 547085 | n/a | n/a | CCAGGTGCAGCACGGAGAGG | 5-10-5 | 44 | 34479 | 34498 | 1216 |
| 547723 | n/a | n/a | TAGAATGGCAGGGTTCTGTG | 5-10-5 | 53 | 27357 | 27376 | 1217 |
| 547724 | n/a | n/a | GATGCATCCAACACTTACCC | 5-10-5 | 16 | 28059 | 28078 | 1218 |
| 547725 | n/a | n/a | ATTGGTGGTGGGATTGGTGG | 5-10-5 | 26 | 28334 28389 28444 28523 28609 28621 | 28353 28408 28463 28542 28628 28640 | 1219 |
| 547726 | n/a | n/a | GCAGGATTGGTGGTGGAATT | 5-10-5 | 0 | 28351 | 28370 | 1220 |
| 547727 | n/a | n/a | TGGCAGGATTGGTGGTGGAA | 5-10-5 | 0 | 28353 | 28372 | 1221 |
| 547728 | n/a | n/a | GAGATTGGTGGTGGGTGGCA | 5-10-5 | 88 | 28368 | 28387 | 1222 |
| 547729 | n/a | n/a | GTGAGATTGGTGGTGGGTGG | 5-10-5 | 45 | 28370 | 28389 | 1223 |
| 547730 | n/a | n/a | GATTGGTGGTGGGATTGGTG | 5-10-5 | 60 | 28390 28433 28445 28524 28610 28622 | 28409 28452 28464 28543 28629 28641 | 1224 |
| 547731 | n/a | n/a | GGATTGGTGGTGGGATTGGT | 5-10-5 | 49 | 28391 28434 28446 28525 28611 28623 | 28410 28453 28465 28544 28630 28642 | 1225 |
| 547732 | n/a | n/a | AGGATTGGTGGTGGGATTGG | 5-10-5 | 0 | 28392 | 28411 | 1226 |
| 547733 | n/a | n/a | TAGGATTGGTGGTGGGATTG | 5-10-5 | 0 | 28393 | 28412 | 1227 |
| 547734 | n/a | n/a | GTAGGATTGGTGGTGGGATT | 5-10-5 | 14 | 28394 | 28413 | 1228 |
| 547735 | n/a | n/a | GGTAGGATTGGTGGTGGGAT | 5-10-5 | 39 | 28395 | 28414 | 1229 |
| 547736 | n/a | n/a | TGGTAGGATTGGTGGTGGGA | 5-10-5 | 54 | 28396 | 28415 | 1230 |
| 547737 | n/a | n/a | TGGTGGTGGGATTGGTGCTG | 5-10-5 | 59 | 28430 | 28449 | 1231 |
| 547738 | n/a | n/a | TTGGTGGTGGGATTGGTGCT | 5-10-5 | 41 | 28431 | 28450 | 1232 |
| 547739 | n/a | n/a | ATTGGTGGTGGGATTGGTGC | 5-10-5 | 12 | 28432 | 28451 | 1233 |

TABLE 17-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 547740 | n/a | n/a | AGGTGGTGGGATTGGTGGTG | 5-10-5 | 30 | 28454 28533 | 28473 28552 | 1234 |
| 547741 | n/a | n/a | TAGGTGGTGGGATTGGTGGT | 5-10-5 | 47 | 28455 28534 | 28474 28553 | 1235 |
| 547742 | n/a | n/a | ATCGGTGGTGGGATTGGTCG | 5-10-5 | 57 | 28499 28578 | 28518 28597 | 1236 |
| 547743 | n/a | n/a | GGTGGTGGGATTGGTGGCGG | 5-10-5 | 61 | 28520 | 28539 | 1237 |
| 547744 | n/a | n/a | TGGTGGTGGGATTGGTGGCG | 5-10-5 | 65 | 28521 | 28540 | 1238 |
| 547745 | n/a | n/a | TTGGTGGTGGGATTGGTGGC | 5-10-5 | 55 | 28522 | 28541 | 1239 |
| 547746 | n/a | n/a | GTTGGTGGCGGGATCGGTGG | 5-10-5 | 0 | 28590 | 28609 | 1240 |
| 547748 | n/a | n/a | GGTTGGTGGCGGGATCGGTG | 5-10-5 | 78 | 28591 | 28610 | 1241 |
| 547750 | n/a | n/a | TGGTTGGTGGCGGGATCGGT | 5-10-5 | 41 | 28592 | 28611 | 1242 |
| 547752 | n/a | n/a | GTGGTTGGTGGCGGGATCGG | 5-10-5 | 41 | 28593 | 28612 | 1243 |
| 547754 | n/a | n/a | GGGATTGGTGGTTGGTGGCG | 5-10-5 | 47 | 28600 | 28619 | 1244 |
| 547756 | n/a | n/a | GGGTCTTGCTCCACCCACAT | 5-10-5 | 49 | 29244 | 29263 | 1245 |
| 547758 | n/a | n/a | CCAAGTAGTGCAAGGCATGT | 5-10-5 | 24 | 29540 | 29559 | 1246 |
| 547760 | n/a | n/a | ATCATGCTTACTGCAAGTGA | 5-10-5 | 19 | 30219 | 30238 | 1247 |
| 547762 | n/a | n/a | TGAAACTGGGCAGTCCTTCC | 5-10-5 | 0 | 30417 | 30436 | 1248 |
| 547764 | n/a | n/a | CCACCTTCTTACATATGCTA | 5-10-5 | 24 | 30644 | 30663 | 1249 |
| 547766 | n/a | n/a | GCCTCTCAGACGGCACAGAC | 5-10-5 | 0 | 30902 | 30921 | 1250 |
| 547768 | n/a | n/a | TTGCCCTCACACATTCGAAT | 5-10-5 | 0 | 30977 | 30996 | 1251 |
| 547770 | n/a | n/a | TGCTTTCTGCCCAACCTCTA | 5-10-5 | 48 | 31727 | 31746 | 1252 |
| 547772 | n/a | n/a | CTGTGCTCCCGGCCATTAGC | 5-10-5 | 0 | 32312 | 32331 | 1253 |
| 547774 | n/a | n/a | GAGACAGTTTGGCAAGCTAC | 5-10-5 | 46 | 32389 | 32408 | 1254 |
| 547776 | n/a | n/a | GGAGAGAGACGGCACCCTGT | 5-10-5 | 48 | 32828 | 32847 | 1255 |
| 547778 | n/a | n/a | TCACCTGTGAGTAACCAATA | 5-10-5 | 53 | 33085 | 33104 | 1256 |
| 547780 | n/a | n/a | CCCCTCTTAAATAGCACATG | 5-10-5 | 67 | 33441 | 33460 | 1257 |
| 547782 | n/a | n/a | CCAAGTATCTCATGTGCCTG | 5-10-5 | 67 | 33580 | 33599 | 1258 |

TABLE 18

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 531231 | n/a | n/a | TATCACTGTACTAGTTTCCT | 5-10-5 | 90 | 14744 14815 14886 14945 15005 15077 15220 | 14763 14834 14905 14964 15024 15096 15239 | 334 |

TABLE 18-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| | | | | | | 15292 | 15311 | |
| | | | | | | 15351 | 15370 | |
| | | | | | | 15411 | 15430 | |
| | | | | | | 15483 | 15502 | |
| | | | | | | 15555 | 15574 | |
| | | | | | | 15613 | 15632 | |
| | | | | | | 15685 | 15704 | |
| | | | | | | 15815 | 15834 | |
| | | | | | | 15887 | 15906 | |
| | | | | | | 15945 | 15964 | |
| 548706 | n/a | n/a | CTAGTTTCCTATAACT | 3-10-3 | 0 | 14738 | 14753 | 1259 |
| | | | | | | 14809 | 14824 | |
| | | | | | | 14880 | 14895 | |
| | | | | | | 14939 | 14954 | |
| | | | | | | 15071 | 15086 | |
| | | | | | | 15214 | 15229 | |
| | | | | | | 15286 | 15301 | |
| | | | | | | 15345 | 15360 | |
| | | | | | | 15477 | 15492 | |
| | | | | | | 15549 | 15564 | |
| | | | | | | 15607 | 15622 | |
| | | | | | | 15679 | 15694 | |
| | | | | | | 15750 | 15765 | |
| | | | | | | 15809 | 15824 | |
| | | | | | | 15881 | 15896 | |
| | | | | | | 15939 | 15954 | |
| 548707 | n/a | n/a | ACTAGTTTCCTATAAC | 3-10-3 | 10 | 14739 | 14754 | 1260 |
| | | | | | | 14810 | 14825 | |
| | | | | | | 14881 | 14896 | |
| | | | | | | 14940 | 14955 | |
| | | | | | | 15000 | 15015 | |
| | | | | | | 15072 | 15087 | |
| | | | | | | 15215 | 15230 | |
| | | | | | | 15287 | 15302 | |
| | | | | | | 15346 | 15361 | |
| | | | | | | 15406 | 15421 | |
| | | | | | | 15478 | 15493 | |
| | | | | | | 15550 | 15565 | |
| | | | | | | 15608 | 15623 | |
| | | | | | | 15680 | 15695 | |
| | | | | | | 15751 | 15766 | |
| | | | | | | 15810 | 15825 | |
| | | | | | | 15882 | 15897 | |
| | | | | | | 15940 | 15955 | |
| 548708 | n/a | n/a | TACTAGTTTCCTATAA | 3-10-3 | 0 | 14740 | 14755 | 1261 |
| | | | | | | 14811 | 14826 | |
| | | | | | | 14882 | 14897 | |
| | | | | | | 14941 | 14956 | |
| | | | | | | 15001 | 15016 | |
| | | | | | | 15073 | 15088 | |
| | | | | | | 15216 | 15231 | |
| | | | | | | 15288 | 15303 | |
| | | | | | | 15347 | 15362 | |
| | | | | | | 15407 | 15422 | |
| | | | | | | 15479 | 15494 | |
| | | | | | | 15551 | 15566 | |
| | | | | | | 15609 | 15624 | |
| | | | | | | 15681 | 15696 | |
| | | | | | | 15752 | 15767 | |
| | | | | | | 15811 | 15826 | |
| | | | | | | 15883 | 15898 | |
| | | | | | | 15941 | 15956 | |
| 548709 | n/a | n/a | GTACTAGTTTCCTATA | 3-10-3 | 0 | 14741 | 14756 | 1262 |
| | | | | | | 14812 | 14827 | |
| | | | | | | 14883 | 14898 | |
| | | | | | | 14942 | 14957 | |
| | | | | | | 15002 | 15017 | |
| | | | | | | 15074 | 15089 | |
| | | | | | | 15217 | 15232 | |

TABLE 18-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| | | | | | | 15289 | 15304 | |
| | | | | | | 15348 | 15363 | |
| | | | | | | 15408 | 15423 | |
| | | | | | | 15480 | 15495 | |
| | | | | | | 15552 | 15567 | |
| | | | | | | 15610 | 15625 | |
| | | | | | | 15682 | 15697 | |
| | | | | | | 15753 | 15768 | |
| | | | | | | 15812 | 15827 | |
| | | | | | | 15884 | 15899 | |
| | | | | | | 15942 | 15957 | |
| 548710 | n/a | n/a | TGTACTAGTTTCCTAT | 3-10-3 | 0 | 14742 | 14757 | 1263 |
| | | | | | | 14813 | 14828 | |
| | | | | | | 14884 | 14899 | |
| | | | | | | 14943 | 14958 | |
| | | | | | | 15003 | 15018 | |
| | | | | | | 15075 | 15090 | |
| | | | | | | 15218 | 15233 | |
| | | | | | | 15290 | 15305 | |
| | | | | | | 15349 | 15364 | |
| | | | | | | 15409 | 15424 | |
| | | | | | | 15481 | 15496 | |
| | | | | | | 15553 | 15568 | |
| | | | | | | 15611 | 15626 | |
| | | | | | | 15683 | 15698 | |
| | | | | | | 15813 | 15828 | |
| | | | | | | 15885 | 15900 | |
| | | | | | | 15943 | 15958 | |
| 548711 | n/a | n/a | CTGTACTAGTTTCCTA | 3-10-3 | 21 | 14743 | 14758 | 1264 |
| | | | | | | 14814 | 14829 | |
| | | | | | | 14885 | 14900 | |
| | | | | | | 14944 | 14959 | |
| | | | | | | 15004 | 15019 | |
| | | | | | | 15076 | 15091 | |
| | | | | | | 15219 | 15234 | |
| | | | | | | 15291 | 15306 | |
| | | | | | | 15350 | 15365 | |
| | | | | | | 15410 | 15425 | |
| | | | | | | 15482 | 15497 | |
| | | | | | | 15554 | 15569 | |
| | | | | | | 15612 | 15627 | |
| | | | | | | 15684 | 15699 | |
| | | | | | | 15814 | 15829 | |
| | | | | | | 15886 | 15901 | |
| | | | | | | 15944 | 15959 | |
| 548712 | n/a | n/a | ACTGTACTAGTTTCCT | 3-10-3 | 9 | 14744 | 14759 | 1265 |
| | | | | | | 14815 | 14830 | |
| | | | | | | 14886 | 14901 | |
| | | | | | | 14945 | 14960 | |
| | | | | | | 15005 | 15020 | |
| | | | | | | 15077 | 15092 | |
| | | | | | | 15220 | 15235 | |
| | | | | | | 15292 | 15307 | |
| | | | | | | 15351 | 15366 | |
| | | | | | | 15411 | 15426 | |
| | | | | | | 15483 | 15498 | |
| | | | | | | 15555 | 15570 | |
| | | | | | | 15613 | 15628 | |
| | | | | | | 15685 | 15700 | |
| | | | | | | 15815 | 15830 | |
| | | | | | | 15887 | 15902 | |
| | | | | | | 15945 | 15960 | |
| 548713 | n/a | n/a | CACTGTACTAGTTTCC | 3-10-3 | 33 | 14745 | 14760 | 1266 |
| | | | | | | 14816 | 14831 | |
| | | | | | | 14887 | 14902 | |
| | | | | | | 14946 | 14961 | |
| | | | | | | 15006 | 15021 | |
| | | | | | | 15078 | 15093 | |
| | | | | | | 15221 | 15236 | |

TABLE 18-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| | | | | | | 15293 | 15308 | |
| | | | | | | 15352 | 15367 | |
| | | | | | | 15412 | 15427 | |
| | | | | | | 15484 | 15499 | |
| | | | | | | 15556 | 15571 | |
| | | | | | | 15614 | 15629 | |
| | | | | | | 15686 | 15701 | |
| | | | | | | 15816 | 15831 | |
| | | | | | | 15888 | 15903 | |
| | | | | | | 15946 | 15961 | |
| 548714 | n/a | n/a | TCACTGTACTAGTTTC | 3-10-3 | 15 | 14746 | 14761 | 1267 |
| | | | | | | 14817 | 14832 | |
| | | | | | | 14888 | 14903 | |
| | | | | | | 14947 | 14962 | |
| | | | | | | 15007 | 15022 | |
| | | | | | | 15079 | 15094 | |
| | | | | | | 15222 | 15237 | |
| | | | | | | 15294 | 15309 | |
| | | | | | | 15353 | 15368 | |
| | | | | | | 15413 | 15428 | |
| | | | | | | 15485 | 15500 | |
| | | | | | | 15557 | 15572 | |
| | | | | | | 15615 | 15630 | |
| | | | | | | 15687 | 15702 | |
| | | | | | | 15817 | 15832 | |
| | | | | | | 15889 | 15904 | |
| | | | | | | 15947 | 15962 | |
| 548715 | n/a | n/a | ATCACTGTACTAGTTT | 3-10-3 | 0 | 14747 | 14762 | 1268 |
| | | | | | | 14818 | 14833 | |
| | | | | | | 14889 | 14904 | |
| | | | | | | 14948 | 14963 | |
| | | | | | | 15008 | 15023 | |
| | | | | | | 15080 | 15095 | |
| | | | | | | 15152 | 15167 | |
| | | | | | | 15223 | 15238 | |
| | | | | | | 15295 | 15310 | |
| | | | | | | 15354 | 15369 | |
| | | | | | | 15414 | 15429 | |
| | | | | | | 15486 | 15501 | |
| | | | | | | 15558 | 15573 | |
| | | | | | | 15616 | 15631 | |
| | | | | | | 15688 | 15703 | |
| | | | | | | 15818 | 15833 | |
| | | | | | | 15890 | 15905 | |
| | | | | | | 15948 | 15963 | |
| 548716 | n/a | n/a | TATCACTGTACTAGTT | 3-10-3 | 10 | 14748 | 14763 | 1269 |
| | | | | | | 14819 | 14834 | |
| | | | | | | 14890 | 14905 | |
| | | | | | | 14949 | 14964 | |
| | | | | | | 15009 | 15024 | |
| | | | | | | 15081 | 15096 | |
| | | | | | | 15153 | 15168 | |
| | | | | | | 15224 | 15239 | |
| | | | | | | 15296 | 15311 | |
| | | | | | | 15355 | 15370 | |
| | | | | | | 15415 | 15430 | |
| | | | | | | 15487 | 15502 | |
| | | | | | | 15559 | 15574 | |
| | | | | | | 15617 | 15632 | |
| | | | | | | 15689 | 15704 | |
| | | | | | | 15819 | 15834 | |
| | | | | | | 15891 | 15906 | |
| | | | | | | 15949 | 15964 | |
| 548717 | n/a | n/a | ACTAGTTTCCTATAACT | 3-10-4 | 0 | 14738 | 14754 | 1270 |
| | | | | | | 14809 | 14825 | |
| | | | | | | 14880 | 14896 | |
| | | | | | | 14939 | 14955 | |
| | | | | | | 15071 | 15087 | |
| | | | | | | 15214 | 15230 | |

TABLE 18-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| | | | | | | 15286 | 15302 | |
| | | | | | | 15345 | 15361 | |
| | | | | | | 15477 | 15493 | |
| | | | | | | 15549 | 15565 | |
| | | | | | | 15607 | 15623 | |
| | | | | | | 15679 | 15695 | |
| | | | | | | 15750 | 15766 | |
| | | | | | | 15809 | 15825 | |
| | | | | | | 15881 | 15897 | |
| | | | | | | 15939 | 15955 | |
| 548718 | n/a | n/a | TACTAGTTTCCTATAAC | 3-10-4 | 0 | 14739 | 14755 | 1271 |
| | | | | | | 14810 | 14826 | |
| | | | | | | 14881 | 14897 | |
| | | | | | | 14940 | 14956 | |
| | | | | | | 15000 | 15016 | |
| | | | | | | 15072 | 15088 | |
| | | | | | | 15215 | 15231 | |
| | | | | | | 15287 | 15303 | |
| | | | | | | 15346 | 15362 | |
| | | | | | | 15406 | 15422 | |
| | | | | | | 15478 | 15494 | |
| | | | | | | 15550 | 15566 | |
| | | | | | | 15608 | 15624 | |
| | | | | | | 15680 | 15696 | |
| | | | | | | 15751 | 15767 | |
| | | | | | | 15810 | 15826 | |
| | | | | | | 15882 | 15898 | |
| | | | | | | 15940 | 15956 | |
| 548719 | n/a | n/a | GTACTAGTTTCCTATAA | 3-10-4 | 0 | 14740 | 14756 | 1272 |
| | | | | | | 14811 | 14827 | |
| | | | | | | 14882 | 14898 | |
| | | | | | | 14941 | 14957 | |
| | | | | | | 15001 | 15017 | |
| | | | | | | 15073 | 15089 | |
| | | | | | | 15216 | 15232 | |
| | | | | | | 15288 | 15304 | |
| | | | | | | 15347 | 15363 | |
| | | | | | | 15407 | 15423 | |
| | | | | | | 15479 | 15495 | |
| | | | | | | 15551 | 15567 | |
| | | | | | | 15609 | 15625 | |
| | | | | | | 15681 | 15697 | |
| | | | | | | 15752 | 15768 | |
| | | | | | | 15811 | 15827 | |
| | | | | | | 15883 | 15899 | |
| | | | | | | 15941 | 15957 | |
| 548720 | n/a | n/a | TGTACTAGTTTCCTATA | 3-10-4 | 0 | 14741 | 14757 | 1273 |
| | | | | | | 14812 | 14828 | |
| | | | | | | 14883 | 14899 | |
| | | | | | | 14942 | 14958 | |
| | | | | | | 15002 | 15018 | |
| | | | | | | 15074 | 15090 | |
| | | | | | | 15217 | 15233 | |
| | | | | | | 15289 | 15305 | |
| | | | | | | 15348 | 15364 | |
| | | | | | | 15408 | 15424 | |
| | | | | | | 15480 | 15496 | |
| | | | | | | 15552 | 15568 | |
| | | | | | | 15610 | 15626 | |
| | | | | | | 15682 | 15698 | |
| | | | | | | 15812 | 15828 | |
| | | | | | | 15884 | 15900 | |
| | | | | | | 15942 | 15958 | |
| 548721 | n/a | n/a | CTGTACTAGTTTCCTAT | 3-10-4 | 27 | 14742 | 14758 | 1274 |
| | | | | | | 14813 | 14829 | |
| | | | | | | 14884 | 14900 | |
| | | | | | | 14943 | 14959 | |
| | | | | | | 15003 | 15019 | |
| | | | | | | 15075 | 15091 | |

TABLE 18-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| | | | | | | 15218 | 15234 | |
| | | | | | | 15290 | 15306 | |
| | | | | | | 15349 | 15365 | |
| | | | | | | 15409 | 15425 | |
| | | | | | | 15481 | 15497 | |
| | | | | | | 15553 | 15569 | |
| | | | | | | 15611 | 15627 | |
| | | | | | | 15683 | 15699 | |
| | | | | | | 15813 | 15829 | |
| | | | | | | 15885 | 15901 | |
| | | | | | | 15943 | 15959 | |
| 548722 | n/a | n/a | ACTGTACTAGTTTCCTA | 3-10-4 | 26 | 14743 | 14759 | 1275 |
| | | | | | | 14814 | 14830 | |
| | | | | | | 14885 | 14901 | |
| | | | | | | 14944 | 14960 | |
| | | | | | | 15004 | 15020 | |
| | | | | | | 15076 | 15092 | |
| | | | | | | 15219 | 15235 | |
| | | | | | | 15291 | 15307 | |
| | | | | | | 15350 | 15366 | |
| | | | | | | 15410 | 15426 | |
| | | | | | | 15482 | 15498 | |
| | | | | | | 15554 | 15570 | |
| | | | | | | 15612 | 15628 | |
| | | | | | | 15684 | 15700 | |
| | | | | | | 15814 | 15830 | |
| | | | | | | 15886 | 15902 | |
| | | | | | | 15944 | 15960 | |
| 548723 | n/a | n/a | CACTGTACTAGTTTCCT | 3-10-4 | 62 | 14744 | 14760 | 1276 |
| | | | | | | 14815 | 14831 | |
| | | | | | | 14886 | 14902 | |
| | | | | | | 14945 | 14961 | |
| | | | | | | 15005 | 15021 | |
| | | | | | | 15077 | 15093 | |
| | | | | | | 15220 | 15236 | |
| | | | | | | 15292 | 15308 | |
| | | | | | | 15351 | 15367 | |
| | | | | | | 15411 | 15427 | |
| | | | | | | 15483 | 15499 | |
| | | | | | | 15555 | 15571 | |
| | | | | | | 15613 | 15629 | |
| | | | | | | 15685 | 15701 | |
| | | | | | | 15815 | 15831 | |
| | | | | | | 15887 | 15903 | |
| | | | | | | 15945 | 15961 | |
| 548724 | n/a | n/a | TCACTGTACTAGTTTCC | 3-10-4 | 61 | 14745 | 14761 | 1277 |
| | | | | | | 14816 | 14832 | |
| | | | | | | 14887 | 14903 | |
| | | | | | | 14946 | 14962 | |
| | | | | | | 15006 | 15022 | |
| | | | | | | 15078 | 15094 | |
| | | | | | | 15221 | 15237 | |
| | | | | | | 15293 | 15309 | |
| | | | | | | 15352 | 15368 | |
| | | | | | | 15412 | 15428 | |
| | | | | | | 15484 | 15500 | |
| | | | | | | 15556 | 15572 | |
| | | | | | | 15614 | 15630 | |
| | | | | | | 15686 | 15702 | |
| | | | | | | 15816 | 15832 | |
| | | | | | | 15888 | 15904 | |
| | | | | | | 15946 | 15962 | |
| 548725 | n/a | n/a | ATCACTGTACTAGTTTC | 3-10-4 | 32 | 14746 | 14762 | 1278 |
| | | | | | | 14817 | 14833 | |
| | | | | | | 14888 | 14904 | |
| | | | | | | 14947 | 14963 | |
| | | | | | | 15007 | 15023 | |
| | | | | | | 15079 | 15095 | |
| | | | | | | 15222 | 15238 | |

TABLE 18-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| | | | | | | 15294 | 15310 | |
| | | | | | | 15353 | 15369 | |
| | | | | | | 15413 | 15429 | |
| | | | | | | 15485 | 15501 | |
| | | | | | | 15557 | 15573 | |
| | | | | | | 15615 | 15631 | |
| | | | | | | 15687 | 15703 | |
| | | | | | | 15817 | 15833 | |
| | | | | | | 15889 | 15905 | |
| | | | | | | 15947 | 15963 | |
| 548726 | n/a | n/a | TATCACTGTACTAGTTT | 3-10-4 | 21 | 14747 | 14763 | 1279 |
| | | | | | | 14818 | 14834 | |
| | | | | | | 14889 | 14905 | |
| | | | | | | 14948 | 14964 | |
| | | | | | | 15008 | 15024 | |
| | | | | | | 15080 | 15096 | |
| | | | | | | 15152 | 15168 | |
| | | | | | | 15223 | 15239 | |
| | | | | | | 15295 | 15311 | |
| | | | | | | 15354 | 15370 | |
| | | | | | | 15414 | 15430 | |
| | | | | | | 15486 | 15502 | |
| | | | | | | 15558 | 15574 | |
| | | | | | | 15616 | 15632 | |
| | | | | | | 15688 | 15704 | |
| | | | | | | 15818 | 15834 | |
| | | | | | | 15890 | 15906 | |
| | | | | | | 15948 | 15964 | |
| 548727 | n/a | n/a | ACTAGTTTCCTATAACT | 4-10-3 | 0 | 14738 | 14754 | 1270 |
| | | | | | | 14809 | 14825 | |
| | | | | | | 14880 | 14896 | |
| | | | | | | 14939 | 14955 | |
| | | | | | | 15071 | 15087 | |
| | | | | | | 15214 | 15230 | |
| | | | | | | 15286 | 15302 | |
| | | | | | | 15345 | 15361 | |
| | | | | | | 15477 | 15493 | |
| | | | | | | 15549 | 15565 | |
| | | | | | | 15607 | 15623 | |
| | | | | | | 15679 | 15695 | |
| | | | | | | 15750 | 15766 | |
| | | | | | | 15809 | 15825 | |
| | | | | | | 15881 | 15897 | |
| | | | | | | 15939 | 15955 | |
| 548728 | n/a | n/a | TACTAGTTTCCTATAAC | 4-10-3 | 0 | 14739 | 14755 | 1271 |
| | | | | | | 14810 | 14826 | |
| | | | | | | 14881 | 14897 | |
| | | | | | | 14940 | 14956 | |
| | | | | | | 15000 | 15016 | |
| | | | | | | 15072 | 15088 | |
| | | | | | | 15215 | 15231 | |
| | | | | | | 15287 | 15303 | |
| | | | | | | 15346 | 15362 | |
| | | | | | | 15406 | 15422 | |
| | | | | | | 15478 | 15494 | |
| | | | | | | 15550 | 15566 | |
| | | | | | | 15608 | 15624 | |
| | | | | | | 15680 | 15696 | |
| | | | | | | 15751 | 15767 | |
| | | | | | | 15810 | 15826 | |
| | | | | | | 15882 | 15898 | |
| | | | | | | 15940 | 15956 | |
| 548729 | n/a | n/a | GTACTAGTTTCCTATAA | 4-10-3 | 13 | 14740 | 14756 | 1272 |
| | | | | | | 14811 | 14827 | |
| | | | | | | 14882 | 14898 | |
| | | | | | | 14941 | 14957 | |
| | | | | | | 15001 | 15017 | |
| | | | | | | 15073 | 15089 | |
| | | | | | | 15216 | 15232 | |

TABLE 18-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| | | | | | | 15288 | 15304 | |
| | | | | | | 15347 | 15363 | |
| | | | | | | 15407 | 15423 | |
| | | | | | | 15479 | 15495 | |
| | | | | | | 15551 | 15567 | |
| | | | | | | 15609 | 15625 | |
| | | | | | | 15681 | 15697 | |
| | | | | | | 15752 | 15768 | |
| | | | | | | 15811 | 15827 | |
| | | | | | | 15883 | 15899 | |
| | | | | | | 15941 | 15957 | |
| 548730 | n/a | n/a | TGTACTAGTTTCCTATA | 4-10-3 | 0 | 14741 | 14757 | 1273 |
| | | | | | | 14812 | 14828 | |
| | | | | | | 14883 | 14899 | |
| | | | | | | 14942 | 14958 | |
| | | | | | | 15002 | 15018 | |
| | | | | | | 15074 | 15090 | |
| | | | | | | 15217 | 15233 | |
| | | | | | | 15289 | 15305 | |
| | | | | | | 15348 | 15364 | |
| | | | | | | 15408 | 15424 | |
| | | | | | | 15480 | 15496 | |
| | | | | | | 15552 | 15568 | |
| | | | | | | 15610 | 15626 | |
| | | | | | | 15682 | 15698 | |
| | | | | | | 15812 | 15828 | |
| | | | | | | 15884 | 15900 | |
| | | | | | | 15942 | 15958 | |
| 548731 | n/a | n/a | CTGTACTAGTTTCCTAT | 4-10-3 | 49 | 14742 | 14758 | 1274 |
| | | | | | | 14813 | 14829 | |
| | | | | | | 14884 | 14900 | |
| | | | | | | 14943 | 14959 | |
| | | | | | | 15003 | 15019 | |
| | | | | | | 15075 | 15091 | |
| | | | | | | 15218 | 15234 | |
| | | | | | | 15290 | 15306 | |
| | | | | | | 15349 | 15365 | |
| | | | | | | 15409 | 15425 | |
| | | | | | | 15481 | 15497 | |
| | | | | | | 15553 | 15569 | |
| | | | | | | 15611 | 15627 | |
| | | | | | | 15683 | 15699 | |
| | | | | | | 15813 | 15829 | |
| | | | | | | 15885 | 15901 | |
| | | | | | | 15943 | 15959 | |
| 548732 | n/a | n/a | ACTGTACTAGTTTCCTA | 4-10-3 | 36 | 14743 | 14759 | 1275 |
| | | | | | | 14814 | 14830 | |
| | | | | | | 14885 | 14901 | |
| | | | | | | 14944 | 14960 | |
| | | | | | | 15004 | 15020 | |
| | | | | | | 15076 | 15092 | |
| | | | | | | 15219 | 15235 | |
| | | | | | | 15291 | 15307 | |
| | | | | | | 15350 | 15366 | |
| | | | | | | 15410 | 15426 | |
| | | | | | | 15482 | 15498 | |
| | | | | | | 15554 | 15570 | |
| | | | | | | 15612 | 15628 | |
| | | | | | | 15684 | 15700 | |
| | | | | | | 15814 | 15830 | |
| | | | | | | 15886 | 15902 | |
| | | | | | | 15944 | 15960 | |
| 548733 | n/a | n/a | CACTGTACTAGTTTCCT | 4-10-3 | 84 | 14744 | 14760 | 1276 |
| | | | | | | 14815 | 14831 | |
| | | | | | | 14886 | 14902 | |
| | | | | | | 14945 | 14961 | |
| | | | | | | 15005 | 15021 | |
| | | | | | | 15077 | 15093 | |
| | | | | | | 15220 | 15236 | |

TABLE 18-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| | | | | | | 15292 | 15308 | |
| | | | | | | 15351 | 15367 | |
| | | | | | | 15411 | 15427 | |
| | | | | | | 15483 | 15499 | |
| | | | | | | 15555 | 15571 | |
| | | | | | | 15613 | 15629 | |
| | | | | | | 15685 | 15701 | |
| | | | | | | 15815 | 15831 | |
| | | | | | | 15887 | 15903 | |
| | | | | | | 15945 | 15961 | |
| 548734 | n/a | n/a | TCACTGTACTAGTTTCC | 4-10-3 | 51 | 14745 | 14761 | 1277 |
| | | | | | | 14816 | 14832 | |
| | | | | | | 14887 | 14903 | |
| | | | | | | 14946 | 14962 | |
| | | | | | | 15006 | 15022 | |
| | | | | | | 15078 | 15094 | |
| | | | | | | 15221 | 15237 | |
| | | | | | | 15293 | 15309 | |
| | | | | | | 15352 | 15368 | |
| | | | | | | 15412 | 15428 | |
| | | | | | | 15484 | 15500 | |
| | | | | | | 15556 | 15572 | |
| | | | | | | 15614 | 15630 | |
| | | | | | | 15686 | 15702 | |
| | | | | | | 15816 | 15832 | |
| | | | | | | 15888 | 15904 | |
| | | | | | | 15946 | 15962 | |
| 548735 | n/a | n/a | ATCACTGTACTAGTTTC | 4-10-3 | 48 | 14746 | 14762 | 1278 |
| | | | | | | 14817 | 14833 | |
| | | | | | | 14888 | 14904 | |
| | | | | | | 14947 | 14963 | |
| | | | | | | 15007 | 15023 | |
| | | | | | | 15079 | 15095 | |
| | | | | | | 15222 | 15238 | |
| | | | | | | 15294 | 15310 | |
| | | | | | | 15353 | 15369 | |
| | | | | | | 15413 | 15429 | |
| | | | | | | 15485 | 15501 | |
| | | | | | | 15557 | 15573 | |
| | | | | | | 15615 | 15631 | |
| | | | | | | 15687 | 15703 | |
| | | | | | | 15817 | 15833 | |
| | | | | | | 15889 | 15905 | |
| | | | | | | 15947 | 15963 | |
| 548736 | n/a | n/a | TATCACTGTACTAGTTT | 4-10-3 | 21 | 14747 | 14763 | 1279 |
| | | | | | | 14818 | 14834 | |
| | | | | | | 14889 | 14905 | |
| | | | | | | 14948 | 14964 | |
| | | | | | | 15008 | 15024 | |
| | | | | | | 15080 | 15096 | |
| | | | | | | 15152 | 15168 | |
| | | | | | | 15223 | 15239 | |
| | | | | | | 15295 | 15311 | |
| | | | | | | 15354 | 15370 | |
| | | | | | | 15414 | 15430 | |
| | | | | | | 15486 | 15502 | |
| | | | | | | 15558 | 15574 | |
| | | | | | | 15616 | 15632 | |
| | | | | | | 15688 | 15704 | |
| | | | | | | 15818 | 15834 | |
| | | | | | | 15890 | 15906 | |
| | | | | | | 15948 | 15964 | |
| 548737 | n/a | n/a | ACTAGTTTCCTATAACT | 4-9-4 | 11 | 14738 | 14754 | 1270 |
| | | | | | | 14809 | 14825 | |
| | | | | | | 14880 | 14896 | |
| | | | | | | 14939 | 14955 | |
| | | | | | | 15071 | 15087 | |
| | | | | | | 15214 | 15230 | |
| | | | | | | 15286 | 15302 | |

TABLE 18-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| | | | | | | 15345 | 15361 | |
| | | | | | | 15477 | 15493 | |
| | | | | | | 15549 | 15565 | |
| | | | | | | 15607 | 15623 | |
| | | | | | | 15679 | 15695 | |
| | | | | | | 15750 | 15766 | |
| | | | | | | 15809 | 15825 | |
| | | | | | | 15881 | 15897 | |
| | | | | | | 15939 | 15955 | |
| 548738 | n/a | n/a | TACTAGTTTCCTATAAC | 4-9-4 | 0 | 14739 | 14755 | 1271 |
| | | | | | | 14810 | 14826 | |
| | | | | | | 14881 | 14897 | |
| | | | | | | 14940 | 14956 | |
| | | | | | | 15000 | 15016 | |
| | | | | | | 15072 | 15088 | |
| | | | | | | 15215 | 15231 | |
| | | | | | | 15287 | 15303 | |
| | | | | | | 15346 | 15362 | |
| | | | | | | 15406 | 15422 | |
| | | | | | | 15478 | 15494 | |
| | | | | | | 15550 | 15566 | |
| | | | | | | 15608 | 15624 | |
| | | | | | | 15680 | 15696 | |
| | | | | | | 15751 | 15767 | |
| | | | | | | 15810 | 15826 | |
| | | | | | | 15882 | 15898 | |
| | | | | | | 15940 | 15956 | |
| 548739 | n/a | n/a | GTACTAGTTTCCTATAA | 4-9-4 | 0 | 14740 | 14756 | 1272 |
| | | | | | | 14811 | 14827 | |
| | | | | | | 14882 | 14898 | |
| | | | | | | 14941 | 14957 | |
| | | | | | | 15001 | 15017 | |
| | | | | | | 15073 | 15089 | |
| | | | | | | 15216 | 15232 | |
| | | | | | | 15288 | 15304 | |
| | | | | | | 15347 | 15363 | |
| | | | | | | 15407 | 15423 | |
| | | | | | | 15479 | 15495 | |
| | | | | | | 15551 | 15567 | |
| | | | | | | 15609 | 15625 | |
| | | | | | | 15681 | 15697 | |
| | | | | | | 15752 | 15768 | |
| | | | | | | 15811 | 15827 | |
| | | | | | | 15883 | 15899 | |
| | | | | | | 15941 | 15957 | |
| 548740 | n/a | n/a | TGTACTAGTTTCCTATA | 4-9-4 | 0 | 14741 | 14757 | 1273 |
| | | | | | | 14812 | 14828 | |
| | | | | | | 14883 | 14899 | |
| | | | | | | 14942 | 14958 | |
| | | | | | | 15002 | 15018 | |
| | | | | | | 15074 | 15090 | |
| | | | | | | 15217 | 15233 | |
| | | | | | | 15289 | 15305 | |
| | | | | | | 15348 | 15364 | |
| | | | | | | 15408 | 15424 | |
| | | | | | | 15480 | 15496 | |
| | | | | | | 15552 | 15568 | |
| | | | | | | 15610 | 15626 | |
| | | | | | | 15682 | 15698 | |
| | | | | | | 15812 | 15828 | |
| | | | | | | 15884 | 15900 | |
| | | | | | | 15942 | 15958 | |
| 548741 | n/a | n/a | CTGTACTAGTTTCCTAT | 4-9-4 | 69 | 14742 | 14758 | 1274 |
| | | | | | | 14813 | 14829 | |
| | | | | | | 14884 | 14900 | |
| | | | | | | 14943 | 14959 | |
| | | | | | | 15003 | 15019 | |
| | | | | | | 15075 | 15091 | |
| | | | | | | 15218 | 15234 | |

TABLE 18-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| | | | | | | 15290 | 15306 | |
| | | | | | | 15349 | 15365 | |
| | | | | | | 15409 | 15425 | |
| | | | | | | 15481 | 15497 | |
| | | | | | | 15553 | 15569 | |
| | | | | | | 15611 | 15627 | |
| | | | | | | 15683 | 15699 | |
| | | | | | | 15813 | 15829 | |
| | | | | | | 15885 | 15901 | |
| | | | | | | 15943 | 15959 | |
| 548742 | n/a | n/a | ACTGTACTAGTTTCCTA | 4-9-4 | 50 | 14743 | 14759 | 1275 |
| | | | | | | 14814 | 14830 | |
| | | | | | | 14885 | 14901 | |
| | | | | | | 14944 | 14960 | |
| | | | | | | 15004 | 15020 | |
| | | | | | | 15076 | 15092 | |
| | | | | | | 15219 | 15235 | |
| | | | | | | 15291 | 15307 | |
| | | | | | | 15350 | 15366 | |
| | | | | | | 15410 | 15426 | |
| | | | | | | 15482 | 15498 | |
| | | | | | | 15554 | 15570 | |
| | | | | | | 15612 | 15628 | |
| | | | | | | 15684 | 15700 | |
| | | | | | | 15814 | 15830 | |
| | | | | | | 15886 | 15902 | |
| | | | | | | 15944 | 15960 | |
| 548743 | n/a | n/a | CACTGTACTAGTTTCCT | 4-9-4 | 80 | 14744 | 14760 | 1276 |
| | | | | | | 14815 | 14831 | |
| | | | | | | 14886 | 14902 | |
| | | | | | | 14945 | 14961 | |
| | | | | | | 15005 | 15021 | |
| | | | | | | 15077 | 15093 | |
| | | | | | | 15220 | 15236 | |
| | | | | | | 15292 | 15308 | |
| | | | | | | 15351 | 15367 | |
| | | | | | | 15411 | 15427 | |
| | | | | | | 15483 | 15499 | |
| | | | | | | 15555 | 15571 | |
| | | | | | | 15613 | 15629 | |
| | | | | | | 15685 | 15701 | |
| | | | | | | 15815 | 15831 | |
| | | | | | | 15887 | 15903 | |
| | | | | | | 15945 | 15961 | |
| 548744 | n/a | n/a | TCACTGTACTAGTTTCC | 4-9-4 | 83 | 14745 | 14761 | 1277 |
| | | | | | | 14816 | 14832 | |
| | | | | | | 14887 | 14903 | |
| | | | | | | 14946 | 14962 | |
| | | | | | | 15006 | 15022 | |
| | | | | | | 15078 | 15094 | |
| | | | | | | 15221 | 15237 | |
| | | | | | | 15293 | 15309 | |
| | | | | | | 15352 | 15368 | |
| | | | | | | 15412 | 15428 | |
| | | | | | | 15484 | 15500 | |
| | | | | | | 15556 | 15572 | |
| | | | | | | 15614 | 15630 | |
| | | | | | | 15686 | 15702 | |
| | | | | | | 15816 | 15832 | |
| | | | | | | 15888 | 15904 | |
| | | | | | | 15946 | 15962 | |
| 548745 | n/a | n/a | ATCACTGTACTAGTTTC | 4-9-4 | 71 | 14746 | 14762 | 1278 |
| | | | | | | 14817 | 14833 | |
| | | | | | | 14888 | 14904 | |
| | | | | | | 14947 | 14963 | |
| | | | | | | 15007 | 15023 | |
| | | | | | | 15079 | 15095 | |
| | | | | | | 15222 | 15238 | |
| | | | | | | 15294 | 15310 | |

TABLE 18-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| | | | | | | 15353 | 15369 | |
| | | | | | | 15413 | 15429 | |
| | | | | | | 15485 | 15501 | |
| | | | | | | 15557 | 15573 | |
| | | | | | | 15615 | 15631 | |
| | | | | | | 15687 | 15703 | |
| | | | | | | 15817 | 15833 | |
| | | | | | | 15889 | 15905 | |
| | | | | | | 15947 | 15963 | |
| 548746 | n/a | n/a | TATCACTGTACTAGTTT | 4-9-4 | 40 | 14747 | 14763 | 1279 |
| | | | | | | 14818 | 14834 | |
| | | | | | | 14889 | 14905 | |
| | | | | | | 14948 | 14964 | |
| | | | | | | 15008 | 15024 | |
| | | | | | | 15080 | 15096 | |
| | | | | | | 15152 | 15168 | |
| | | | | | | 15223 | 15239 | |
| | | | | | | 15295 | 15311 | |
| | | | | | | 15354 | 15370 | |
| | | | | | | 15414 | 15430 | |
| | | | | | | 15486 | 15502 | |
| | | | | | | 15558 | 15574 | |
| | | | | | | 15616 | 15632 | |
| | | | | | | 15688 | 15704 | |
| | | | | | | 15818 | 15834 | |
| | | | | | | 15890 | 15906 | |
| | | | | | | 15948 | 15964 | |
| 548747 | n/a | n/a | TACTAGTTTCCTATAACT | 4-10-4 | 2 | 14738 | 14755 | 1280 |
| | | | | | | 14809 | 14826 | |
| | | | | | | 14880 | 14897 | |
| | | | | | | 14939 | 14956 | |
| | | | | | | 15071 | 15088 | |
| | | | | | | 15214 | 15231 | |
| | | | | | | 15286 | 15303 | |
| | | | | | | 15345 | 15362 | |
| | | | | | | 15477 | 15494 | |
| | | | | | | 15549 | 15566 | |
| | | | | | | 15607 | 15624 | |
| | | | | | | 15679 | 15696 | |
| | | | | | | 15750 | 15767 | |
| | | | | | | 15809 | 15826 | |
| | | | | | | 15881 | 15898 | |
| | | | | | | 15939 | 15956 | |
| 548748 | n/a | n/a | GTACTAGTTTCCTATAAC | 4-10-4 | 0 | 14739 | 14756 | 1281 |
| | | | | | | 14810 | 14827 | |
| | | | | | | 14881 | 14898 | |
| | | | | | | 14940 | 14957 | |
| | | | | | | 15000 | 15017 | |
| | | | | | | 15072 | 15089 | |
| | | | | | | 15215 | 15232 | |
| | | | | | | 15287 | 15304 | |
| | | | | | | 15346 | 15363 | |
| | | | | | | 15406 | 15423 | |
| | | | | | | 15478 | 15495 | |
| | | | | | | 15550 | 15567 | |
| | | | | | | 15608 | 15625 | |
| | | | | | | 15680 | 15697 | |
| | | | | | | 15751 | 15768 | |
| | | | | | | 15810 | 15827 | |
| | | | | | | 15882 | 15899 | |
| | | | | | | 15940 | 15957 | |
| 548749 | n/a | n/a | TGTACTAGTTTCCTATAA | 4-10-4 | 0 | 14740 | 14757 | 1282 |
| | | | | | | 14811 | 14828 | |
| | | | | | | 14882 | 14899 | |
| | | | | | | 14941 | 14958 | |
| | | | | | | 15001 | 15018 | |
| | | | | | | 15073 | 15090 | |
| | | | | | | 15216 | 15233 | |
| | | | | | | 15288 | 15305 | |

TABLE 18-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| | | | | | | 15347 | 15364 | |
| | | | | | | 15407 | 15424 | |
| | | | | | | 15479 | 15496 | |
| | | | | | | 15551 | 15568 | |
| | | | | | | 15609 | 15626 | |
| | | | | | | 15681 | 15698 | |
| | | | | | | 15811 | 15828 | |
| | | | | | | 15883 | 15900 | |
| | | | | | | 15941 | 15958 | |
| 548750 | n/a | n/a | CTGTACTAGTTTCCTATA | 4-10-4 | 62 | 14741 | 14758 | 1283 |
| | | | | | | 14812 | 14829 | |
| | | | | | | 14883 | 14900 | |
| | | | | | | 14942 | 14959 | |
| | | | | | | 15002 | 15019 | |
| | | | | | | 15074 | 15091 | |
| | | | | | | 15217 | 15234 | |
| | | | | | | 15289 | 15306 | |
| | | | | | | 15348 | 15365 | |
| | | | | | | 15408 | 15425 | |
| | | | | | | 15480 | 15497 | |
| | | | | | | 15552 | 15569 | |
| | | | | | | 15610 | 15627 | |
| | | | | | | 15682 | 15699 | |
| | | | | | | 15812 | 15829 | |
| | | | | | | 15884 | 15901 | |
| | | | | | | 15942 | 15959 | |
| 548751 | n/a | n/a | ACTGTACTAGTTTCCTAT | 4-10-4 | 53 | 14742 | 14759 | 1284 |
| | | | | | | 14813 | 14830 | |
| | | | | | | 14884 | 14901 | |
| | | | | | | 14943 | 14960 | |
| | | | | | | 15003 | 15020 | |
| | | | | | | 15075 | 15092 | |
| | | | | | | 15218 | 15235 | |
| | | | | | | 15290 | 15307 | |
| | | | | | | 15349 | 15366 | |
| | | | | | | 15409 | 15426 | |
| | | | | | | 15481 | 15498 | |
| | | | | | | 15553 | 15570 | |
| | | | | | | 15611 | 15628 | |
| | | | | | | 15683 | 15700 | |
| | | | | | | 15813 | 15830 | |
| | | | | | | 15885 | 15902 | |
| | | | | | | 15943 | 15960 | |
| 548752 | n/a | n/a | CACTGTACTAGTTTCCTA | 4-10-4 | 89 | 14743 | 14760 | 1285 |
| | | | | | | 14814 | 14831 | |
| | | | | | | 14885 | 14902 | |
| | | | | | | 14944 | 14961 | |
| | | | | | | 15004 | 15021 | |
| | | | | | | 15076 | 15093 | |
| | | | | | | 15219 | 15236 | |
| | | | | | | 15291 | 15308 | |
| | | | | | | 15350 | 15367 | |
| | | | | | | 15410 | 15427 | |
| | | | | | | 15482 | 15499 | |
| | | | | | | 15554 | 15571 | |
| | | | | | | 15612 | 15629 | |
| | | | | | | 15684 | 15701 | |
| | | | | | | 15814 | 15831 | |
| | | | | | | 15886 | 15903 | |
| | | | | | | 15944 | 15961 | |
| 548753 | n/a | n/a | TCACTGTACTAGTTTCCT | 4-10-4 | 82 | 14744 | 14761 | 1286 |
| | | | | | | 14815 | 14832 | |
| | | | | | | 14886 | 14903 | |
| | | | | | | 14945 | 14962 | |
| | | | | | | 15005 | 15022 | |
| | | | | | | 15077 | 15094 | |
| | | | | | | 15220 | 15237 | |
| | | | | | | 15292 | 15309 | |
| | | | | | | 15351 | 15368 | |

TABLE 18-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| | | | | | | 15411 | 15428 | |
| | | | | | | 15483 | 15500 | |
| | | | | | | 15555 | 15572 | |
| | | | | | | 15613 | 15630 | |
| | | | | | | 15685 | 15702 | |
| | | | | | | 15815 | 15832 | |
| | | | | | | 15887 | 15904 | |
| | | | | | | 15945 | 15962 | |
| 548754 | n/a | n/a | ATCACTGTACTAGTTTCC | 4-10-4 | 77 | 14745 | 14762 | 1287 |
| | | | | | | 14816 | 14833 | |
| | | | | | | 14887 | 14904 | |
| | | | | | | 14946 | 14963 | |
| | | | | | | 15006 | 15023 | |
| | | | | | | 15078 | 15095 | |
| | | | | | | 15221 | 15238 | |
| | | | | | | 15293 | 15310 | |
| | | | | | | 15352 | 15369 | |
| | | | | | | 15412 | 15429 | |
| | | | | | | 15484 | 15501 | |
| | | | | | | 15556 | 15573 | |
| | | | | | | 15614 | 15631 | |
| | | | | | | 15686 | 15703 | |
| | | | | | | 15816 | 15833 | |
| | | | | | | 15888 | 15905 | |
| | | | | | | 15946 | 15963 | |
| 548755 | n/a | n/a | TATCACTGTACTAGTTTC | 4-10-4 | 20 | 14746 | 14763 | 1288 |
| | | | | | | 14817 | 14834 | |
| | | | | | | 14888 | 14905 | |
| | | | | | | 14947 | 14964 | |
| | | | | | | 15007 | 15024 | |
| | | | | | | 15079 | 15096 | |
| | | | | | | 15222 | 15239 | |
| | | | | | | 15294 | 15311 | |
| | | | | | | 15353 | 15370 | |
| | | | | | | 15413 | 15430 | |
| | | | | | | 15485 | 15502 | |
| | | | | | | 15557 | 15574 | |
| | | | | | | 15615 | 15632 | |
| | | | | | | 15687 | 15704 | |
| | | | | | | 15817 | 15834 | |
| | | | | | | 15889 | 15906 | |
| | | | | | | 15947 | 15964 | |
| 548756 | n/a | n/a | GTATCACTGTACTAGTT | 4-9-4 | 81 | 14748 | 14764 | 1289 |
| | | | | | | 14819 | 14835 | |
| | | | | | | 14890 | 14906 | |
| | | | | | | 14949 | 14965 | |
| | | | | | | 15009 | 15025 | |
| | | | | | | 15081 | 15097 | |
| | | | | | | 15153 | 15169 | |
| | | | | | | 15224 | 15240 | |
| | | | | | | 15296 | 15312 | |
| | | | | | | 15355 | 15371 | |
| | | | | | | 15415 | 15431 | |
| | | | | | | 15487 | 15503 | |
| | | | | | | 15559 | 15575 | |
| | | | | | | 15617 | 15633 | |
| | | | | | | 15689 | 15705 | |
| | | | | | | 15819 | 15835 | |
| | | | | | | 15891 | 15907 | |
| | | | | | | 15949 | 15965 | |
| 548757 | n/a | n/a | AGTATCACTGTACTAGT | 4-9-4 | 87 | 14749 | 14765 | 1290 |
| | | | | | | 14820 | 14836 | |
| | | | | | | 14891 | 14907 | |
| | | | | | | 14950 | 14966 | |
| | | | | | | 15010 | 15026 | |
| | | | | | | 15082 | 15098 | |
| | | | | | | 15154 | 15170 | |
| | | | | | | 15225 | 15241 | |
| | | | | | | 15297 | 15313 | |

TABLE 18-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| | | | | | | 15356 | 15372 | |
| | | | | | | 15416 | 15432 | |
| | | | | | | 15488 | 15504 | |
| | | | | | | 15560 | 15576 | |
| | | | | | | 15618 | 15634 | |
| | | | | | | 15690 | 15706 | |
| | | | | | | 15820 | 15836 | |
| | | | | | | 15892 | 15908 | |
| | | | | | | 15950 | 15966 | |
| 548758 | n/a | n/a | CAGTATCACTGTACTAG | 4-9-4 | 97 | 14750 | 14766 | 1291 |
| | | | | | | 14821 | 14837 | |
| | | | | | | 14892 | 14908 | |
| | | | | | | 14951 | 14967 | |
| | | | | | | 15011 | 15027 | |
| | | | | | | 15083 | 15099 | |
| | | | | | | 15155 | 15171 | |
| | | | | | | 15226 | 15242 | |
| | | | | | | 15298 | 15314 | |
| | | | | | | 15357 | 15373 | |
| | | | | | | 15417 | 15433 | |
| | | | | | | 15489 | 15505 | |
| | | | | | | 15561 | 15577 | |
| | | | | | | 15619 | 15635 | |
| | | | | | | 15691 | 15707 | |
| | | | | | | 15821 | 15837 | |
| | | | | | | 15893 | 15909 | |
| | | | | | | 15951 | 15967 | |
| 548759 | n/a | n/a | AACAGTATCACTGTACT | 4-9-4 | 68 | 14752 | 14768 | 1292 |
| | | | | | | 14823 | 14839 | |
| | | | | | | 14894 | 14910 | |
| | | | | | | 14953 | 14969 | |
| | | | | | | 15013 | 15029 | |
| | | | | | | 15085 | 15101 | |
| | | | | | | 15157 | 15173 | |
| | | | | | | 15228 | 15244 | |
| | | | | | | 15300 | 15316 | |
| | | | | | | 15359 | 15375 | |
| | | | | | | 15419 | 15435 | |
| | | | | | | 15491 | 15507 | |
| | | | | | | 15563 | 15579 | |
| | | | | | | 15621 | 15637 | |
| | | | | | | 15693 | 15709 | |
| | | | | | | 15823 | 15839 | |
| | | | | | | 15895 | 15911 | |
| | | | | | | 15953 | 15969 | |
| 548760 | n/a | n/a | TAACAGTATCACTGTAC | 4-9-4 | 53 | 14753 | 14769 | 1293 |
| | | | | | | 14824 | 14840 | |
| | | | | | | 14895 | 14911 | |
| | | | | | | 14954 | 14970 | |
| | | | | | | 15014 | 15030 | |
| | | | | | | 15086 | 15102 | |
| | | | | | | 15158 | 15174 | |
| | | | | | | 15229 | 15245 | |
| | | | | | | 15301 | 15317 | |
| | | | | | | 15360 | 15376 | |
| | | | | | | 15420 | 15436 | |
| | | | | | | 15492 | 15508 | |
| | | | | | | 15564 | 15580 | |
| | | | | | | 15622 | 15638 | |
| | | | | | | 15694 | 15710 | |
| | | | | | | 15824 | 15840 | |
| | | | | | | 15896 | 15912 | |
| | | | | | | 15954 | 15970 | |
| 548761 | n/a | n/a | CTAACAGTATCACTGTA | 4-9-4 | 49 | 14754 | 14770 | 1294 |
| | | | | | | 14825 | 14841 | |
| | | | | | | 14896 | 14912 | |
| | | | | | | 15015 | 15031 | |
| | | | | | | 15087 | 15103 | |
| | | | | | | 15230 | 15246 | |

TABLE 18-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| | | | | | | 15302 | 15318 | |
| | | | | | | 15421 | 15437 | |
| | | | | | | 15493 | 15509 | |
| | | | | | | 15623 | 15639 | |
| | | | | | | 15825 | 15841 | |
| | | | | | | 15955 | 15971 | |
| 548762 | n/a | n/a | TCTAACAGTATCACTGT | 4-9-4 | 16 | 14755 | 14771 | 1295 |
| | | | | | | 14826 | 14842 | |
| | | | | | | 14897 | 14913 | |
| | | | | | | 15016 | 15032 | |
| | | | | | | 15088 | 15104 | |
| | | | | | | 15231 | 15247 | |
| | | | | | | 15303 | 15319 | |
| | | | | | | 15422 | 15438 | |
| | | | | | | 15494 | 15510 | |
| | | | | | | 15624 | 15640 | |
| | | | | | | 15826 | 15842 | |
| | | | | | | 15956 | 15972 | |
| 548763 | n/a | n/a | CTCTAACAGTATCACTG | 4-9-4 | 44 | 14756 | 14772 | 1296 |
| | | | | | | 14827 | 14843 | |
| | | | | | | 14898 | 14914 | |
| | | | | | | 15017 | 15033 | |
| | | | | | | 15089 | 15105 | |
| | | | | | | 15232 | 15248 | |
| | | | | | | 15304 | 15320 | |
| | | | | | | 15423 | 15439 | |
| | | | | | | 15495 | 15511 | |
| | | | | | | 15625 | 15641 | |
| | | | | | | 15827 | 15843 | |
| | | | | | | 15957 | 15973 | |
| 548764 | n/a | n/a | TATCACTGTCCTATAAC | 4-9-4 | 31 | 14772 | 14788 | 1297 |
| | | | | | | 14843 | 14859 | |
| | | | | | | 15177 | 15193 | |
| | | | | | | 15583 | 15599 | |
| | | | | | | 15713 | 15729 | |
| | | | | | | 16012 | 16028 | |
| | | | | | | 16083 | 16099 | |
| | | | | | | 16161 | 16177 | |
| | | | | | | 16180 | 16196 | |
| | | | | | | 16231 | 16247 | |
| 548765 | n/a | n/a | ATATCACTGTCCTATAA | 4-9-4 | 0 | 14773 | 14789 | 1298 |
| | | | | | | 14844 | 14860 | |
| | | | | | | 15178 | 15194 | |
| | | | | | | 15584 | 15600 | |
| | | | | | | 15714 | 15730 | |
| | | | | | | 16013 | 16029 | |
| | | | | | | 16084 | 16100 | |
| | | | | | | 16162 | 16178 | |
| | | | | | | 16181 | 16197 | |
| | | | | | | 16232 | 16248 | |
| 548766 | n/a | n/a | TATATCACTGTCCTATA | 4-9-4 | 36 | 14774 | 14790 | 1299 |
| | | | | | | 14845 | 14861 | |
| | | | | | | 15179 | 15195 | |
| | | | | | | 15715 | 15731 | |
| | | | | | | 16163 | 16179 | |
| 548767 | n/a | n/a | TATCACTGTCCTATATC | 4-9-4 | 59 | 14785 | 14801 | 1300 |
| | | | | | | 14856 | 14872 | |
| | | | | | | 14981 | 14997 | |
| | | | | | | 15119 | 15135 | |
| | | | | | | 15190 | 15206 | |
| | | | | | | 15262 | 15278 | |
| | | | | | | 15387 | 15403 | |
| | | | | | | 15525 | 15541 | |
| | | | | | | 15655 | 15671 | |
| | | | | | | 15726 | 15742 | |
| | | | | | | 15857 | 15873 | |
| | | | | | | 15987 | 16003 | |

TABLE 18-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 548768 | n/a | n/a | GTATCACTGTCCTATAT | 4-9-4 | 56 | 14786 | 14802 | 1301 |
| | | | | | | 14982 | 14998 | |
| | | | | | | 15120 | 15136 | |
| | | | | | | 15388 | 15404 | |
| | | | | | | 15526 | 15542 | |
| | | | | | | 15988 | 16004 | |
| 548769 | n/a | n/a | AGTATCACTGTCCTATA | 4-9-4 | 64 | 14787 | 14803 | 1302 |
| | | | | | | 14983 | 14999 | |
| | | | | | | 15121 | 15137 | |
| | | | | | | 15389 | 15405 | |
| | | | | | | 15527 | 15543 | |
| | | | | | | 15989 | 16005 | |
| 548770 | n/a | n/a | TAACAGTATCACTGTCC | 4-9-4 | 92 | 14791 | 14807 | 1303 |
| | | | | | | 14987 | 15003 | |
| | | | | | | 15053 | 15069 | |
| | | | | | | 15125 | 15141 | |
| | | | | | | 15393 | 15409 | |
| | | | | | | 15459 | 15475 | |
| | | | | | | 15531 | 15547 | |
| | | | | | | 15993 | 16009 | |
| 548771 | n/a | n/a | ATAACAGTATCACTGTC | 4-9-4 | 62 | 14792 | 14808 | 1304 |
| | | | | | | 14988 | 15004 | |
| | | | | | | 15054 | 15070 | |
| | | | | | | 15126 | 15142 | |
| | | | | | | 15394 | 15410 | |
| | | | | | | 15460 | 15476 | |
| | | | | | | 15532 | 15548 | |
| | | | | | | 15994 | 16010 | |
| 548772 | n/a | n/a | TATAACAGTATCACTGT | 4-9-4 | 0 | 14793 | 14809 | 1305 |
| | | | | | | 14989 | 15005 | |
| | | | | | | 15055 | 15071 | |
| | | | | | | 15127 | 15143 | |
| | | | | | | 15160 | 15176 | |
| | | | | | | 15362 | 15378 | |
| | | | | | | 15395 | 15411 | |
| | | | | | | 15461 | 15477 | |
| | | | | | | 15533 | 15549 | |
| | | | | | | 15566 | 15582 | |
| | | | | | | 15696 | 15712 | |
| | | | | | | 15898 | 15914 | |
| | | | | | | 15995 | 16011 | |
| 548773 | n/a | n/a | CTATAACAGTATCACTG | 4-9-4 | 0 | 14794 | 14810 | 1306 |
| | | | | | | 14990 | 15006 | |
| | | | | | | 15056 | 15072 | |
| | | | | | | 15128 | 15144 | |
| | | | | | | 15161 | 15177 | |
| | | | | | | 15363 | 15379 | |
| | | | | | | 15396 | 15412 | |
| | | | | | | 15462 | 15478 | |
| | | | | | | 15534 | 15550 | |
| | | | | | | 15567 | 15583 | |
| | | | | | | 15697 | 15713 | |
| | | | | | | 15899 | 15915 | |
| | | | | | | 15996 | 16012 | |
| 548774 | n/a | n/a | CCTATAACTATAACAGT | 4-9-4 | 0 | 14801 | 14817 | 1307 |
| | | | | | | 15063 | 15079 | |
| | | | | | | 15168 | 15184 | |
| | | | | | | 15469 | 15485 | |
| | | | | | | 15541 | 15557 | |
| | | | | | | 15574 | 15590 | |
| | | | | | | 15704 | 15720 | |
| | | | | | | 15775 | 15791 | |
| | | | | | | 16003 | 16019 | |
| 548775 | n/a | n/a | TCCTATAACTATAACAG | 4-9-4 | 0 | 14802 | 14818 | 1308 |
| | | | | | | 15064 | 15080 | |

TABLE 18-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| | | | | | | 15169 | 15185 | |
| | | | | | | 15470 | 15486 | |
| | | | | | | 15542 | 15558 | |
| | | | | | | 15575 | 15591 | |
| | | | | | | 15705 | 15721 | |
| | | | | | | 16004 | 16020 | |
| 548776 | n/a | n/a | CCTATAACTATAACAAT | 4-9-4 | 0 | 14872 | 14888 | 1309 |
| | | | | | | 14931 | 14947 | |
| | | | | | | 15206 | 15222 | |
| | | | | | | 15278 | 15294 | |
| | | | | | | 15337 | 15353 | |
| | | | | | | 15599 | 15615 | |
| | | | | | | 15671 | 15687 | |
| | | | | | | 15742 | 15758 | |
| | | | | | | 15801 | 15817 | |
| | | | | | | 15873 | 15889 | |
| | | | | | | 15931 | 15947 | |
| | | | | | | 16074 | 16090 | |
| | | | | | | 16099 | 16115 | |
| | | | | | | 16152 | 16168 | |
| | | | | | | 16247 | 16263 | |
| 548777 | n/a | n/a | GTAACAGTATCACTGTA | 4-9-4 | 41 | 14955 | 14971 | 1310 |
| 548778 | n/a | n/a | ATAACAGTATCACTGTA | 4-9-4 | 20 | 15159 | 15175 | 1311 |
| | | | | | | 15361 | 15377 | |
| | | | | | | 15565 | 15581 | |
| | | | | | | 15695 | 15711 | |
| | | | | | | 15897 | 15913 | |
| 548779 | n/a | n/a | GTCCTATAACTATAACA | 4-9-4 | 0 | 15170 | 15186 | 1312 |
| | | | | | | 15576 | 15592 | |
| | | | | | | 15706 | 15722 | |
| | | | | | | 16005 | 16021 | |
| | | | | | | 16076 | 16092 | |
| | | | | | | 16101 | 16117 | |
| | | | | | | 16154 | 16170 | |
| 548780 | n/a | n/a | TGTCCTATAACTATAAC | 4-9-4 | 22 | 15171 | 15187 | 1313 |
| | | | | | | 15577 | 15593 | |
| | | | | | | 15707 | 15723 | |
| | | | | | | 16006 | 16022 | |
| | | | | | | 16077 | 16093 | |
| | | | | | | 16102 | 16118 | |
| | | | | | | 16155 | 16171 | |
| 548781 | n/a | n/a | ACCTATAACTATAACAG | 4-9-4 | 0 | 15776 | 15792 | 1314 |
| 548782 | n/a | n/a | TACCTATAACTATAACA | 4-9-4 | 0 | 15777 | 15793 | 1315 |
| | | | | | | 16249 | 16265 | |
| 548783 | n/a | n/a | ACCTATAACTATAACAA | 4-9-4 | 0 | 16248 | 16264 | 1316 |

Example 3: Antisense Inhibition of Human PKK in HepaRG™ Cells by Antisense Oligonucleotides with MOE, Deoxy and cEt Sugar Modifications Additional antisense oligonucleotides were designed targeting a PKK nucleic acid and were tested for their effects on PKK mRNA in vitro.

The chimeric antisense oligonucleotides in the tables below were designed as deoxy, MOE and cEt gapmers. The gapmers are 16 nucleosides in length wherein the nucleoside have either a MOE sugar modification, a cEt sugar modification, or a deoxy modification. The 'Chemistry' column describes the sugar modifications of each oligonucleotide. 'k' indicates an cEt sugar modification; the number indicates the number of deoxynucleosides; otherwise, 'd' indicates a deoxynucleoside; and 'e' indicates a 2'-O-methoxyethyl modification. The internucleoside linkages throughout each gapmer are phosphorothioate linkages. All cytosine residues throughout each oligonucleotide are 5-methylcytosines. "Start site" indicates the 5'-most nucleoside to which the gapmer is targeted in the human gene sequence. "Stop site" indicates the 3'-most nucleoside to which the gapmer is targeted in the human gene sequence. Each gapmer listed in the tables below is targeted to either the human PKK mRNA, designated herein as SEQ ID NO: 1 or the human PKK genomic sequence, designated herein as SEQ ID NO: 10. 'n/a' indicates that the antisense oligonucleotide does not target that particular gene sequence.

Cultured HepaRG™ cells at a density of 20,000 cells per well were transfected using electroporation with 1,000 nM antisense oligonucleotide. After a treatment period of approximately 24 hours, RNA was isolated from the cells and PKK mRNA levels were measured by quantitative real-time PCR. Human primer probe set RTS3454 was used to measure mRNA levels. ISIS 531231 was also included in this assay. PKK mRNA levels were adjusted according to total RNA content, as measured by RIBOGREEN®. The antisense oligonucleotides were tested in a series of experiments that had similar culture conditions. The results for each experiment are presented in separate tables shown below. Results are presented as percent inhibition of PKK, relative to untreated control cells.

TABLE 19

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 547747 | n/a | n/a | TCACTGTACTAGTTTC | eekd$_{10}$kke | 95 | 14746 | 14761 | 1267 |
|  |  |  |  |  |  | 14817 | 14832 |  |
|  |  |  |  |  |  | 14888 | 14903 |  |
|  |  |  |  |  |  | 14947 | 14962 |  |
|  |  |  |  |  |  | 15007 | 15022 |  |
|  |  |  |  |  |  | 15079 | 15094 |  |
|  |  |  |  |  |  | 15222 | 15237 |  |
|  |  |  |  |  |  | 15294 | 15309 |  |
|  |  |  |  |  |  | 15353 | 15368 |  |
|  |  |  |  |  |  | 15413 | 15428 |  |
|  |  |  |  |  |  | 15485 | 15500 |  |
|  |  |  |  |  |  | 15557 | 15572 |  |
|  |  |  |  |  |  | 15615 | 15630 |  |
|  |  |  |  |  |  | 15687 | 15702 |  |
|  |  |  |  |  |  | 15817 | 15832 |  |
|  |  |  |  |  |  | 15889 | 15904 |  |
|  |  |  |  |  |  | 15947 | 15962 |  |
| 548074 | 1642 | 1657 | CCTTTCTCCTTCGAGA | eekd$_{10}$kke | 0 | 31948 | 31963 | 1317 |
| 548075 | 1643 | 1658 | ACCTTTCTCCTTCGAG | eekd$_{10}$kke | 0 | 31949 | 31964 | 1318 |
| 548076 | 1644 | 1659 | CACCTTTCTCCTTCGA | eekd$_{10}$kke | 26 | n/a | n/a | 1319 |
| 548077 | 1691 | 1706 | ATTTGTTACCAAAGGA | eekd$_{10}$kke | 51 | 33135 | 33150 | 1320 |
| 548078 | 1696 | 1711 | TCTTCATTTGTTACCA | eekd$_{10}$kke | 36 | 33140 | 33155 | 1321 |
| 548079 | 1762 | 1777 | CCTTCTTTATAGCCAG | eekd$_{10}$kke | 39 | 33206 | 33221 | 1322 |
| 548080 | 1763 | 1778 | CCCTTCTTTATAGCCA | eekd$_{10}$kke | 0 | 33207 | 33222 | 1323 |
| 548081 | 1764 | 1779 | CCCCTTCTTTATAGCC | eekd$_{10}$kke | 64 | 33208 | 33223 | 1324 |
| 548082 | 1776 | 1791 | AAGCATCTTTTCCCCC | eekd$_{10}$kke | 42 | 33220 | 33235 | 1325 |
| 548083 | 1800 | 1815 | AGGGACCACCTGAATC | eekd$_{10}$kke | 0 | 33899 | 33914 | 1326 |
| 548084 | 1801 | 1816 | AAGGGACCACCTGAAT | eekd$_{10}$kke | 0 | 33900 | 33915 | 1327 |
| 548085 | 1802 | 1817 | TAAGGGACCACCTGAA | eekd$_{10}$kke | 8 | 33901 | 33916 | 1328 |
| 548086 | 1803 | 1818 | CTAAGGGACCACCTGA | eekd$_{10}$kke | 36 | 33902 | 33917 | 1329 |
| 548087 | 1804 | 1819 | ACTAAGGGACCACCTG | eekd$_{10}$kke | 24 | 33903 | 33918 | 1330 |
| 548088 | 1805 | 1820 | AACTAAGGGACCACCT | eekd$_{10}$kke | 27 | 33904 | 33919 | 1331 |
| 548089 | 1806 | 1821 | AAACTAAGGGACCACC | eekd$_{10}$kke | 34 | 33905 | 33920 | 1332 |
| 548090 | 1807 | 1822 | CAAACTAAGGGACCAC | eekd$_{10}$kke | 46 | 33906 | 33921 | 1333 |
| 548091 | 1809 | 1824 | TGCAAACTAAGGGACC | eekd$_{10}$kke | 62 | 33908 | 33923 | 1334 |
| 548092 | 1810 | 1825 | TTGCAAACTAAGGGAC | eekd$_{10}$kke | 30 | 33909 | 33924 | 1335 |
| 548093 | 1811 | 1826 | TTTGCAAACTAAGGGA | eekd$_{10}$kke | 0 | 33910 | 33925 | 1336 |
| 548094 | 1812 | 1827 | GTTTGCAAACTAAGGG | eekd$_{10}$kke | 74 | 33911 | 33926 | 1337 |
| 548095 | 1813 | 1828 | TGTTTGCAAACTAAGG | eekd$_{10}$kke | 35 | 33912 | 33927 | 1338 |
| 548096 | 1814 | 1829 | GTGTTTGCAAACTAAG | eekd$_{10}$kke | 23 | 33913 | 33928 | 1339 |
| 548097 | 1876 | 1891 | TGCTCCCTGCGGGCAC | eekd$_{10}$kke | 2 | 33975 | 33990 | 1340 |

TABLE 19-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 548098 | 1887 | 1902 | AGACACCAGGTTGCTC | eekd$_{10}$kke | 0 | 33986 | 34001 | 1341 |
| 548099 | 1904 | 1919 | CTCAGCGACTTTGGTG | eekd$_{10}$kke | 55 | 34003 | 34018 | 1342 |
| 548100 | 1905 | 1920 | ACTCAGCGACTTTGGT | eekd$_{10}$kke | 25 | 34004 | 34019 | 1343 |
| 548101 | 1906 | 1921 | TACTCAGCGACTTTGG | eekd$_{10}$kke | 47 | 34005 | 34020 | 1344 |
| 548102 | 1907 | 1922 | GTACTCAGCGACTTTG | eekd$_{10}$kke | 58 | 34006 | 34021 | 1345 |
| 548103 | 1908 | 1923 | TGTACTCAGCGACTTT | eekd$_{10}$kke | 66 | 34007 | 34022 | 1346 |
| 548104 | 1909 | 1924 | ATGTACTCAGCGACTT | eekd$_{10}$kke | 59 | 34008 | 34023 | 1347 |
| 548105 | 1910 | 1925 | CATGTACTCAGCGACT | eekd$_{10}$kke | 49 | 34009 | 34024 | 1348 |
| 548106 | 1911 | 1926 | CCATGTACTCAGCGAC | eekd$_{10}$kke | 79 | 34010 | 34025 | 1349 |
| 548107 | 1912 | 1927 | TCCATGTACTCAGCGA | eekd$_{10}$kke | 76 | 34011 | 34026 | 1350 |
| 548108 | 1953 | 1968 | GAGCTTTTCCATCACT | eekd$_{10}$kke | 61 | 34052 | 34067 | 1351 |
| 548109 | 1959 | 1974 | GCATCTGAGCTTTTCC | eekd$_{10}$kke | 77 | 34058 | 34073 | 1352 |
| 548110 | 1960 | 1975 | TGCATCTGAGCTTTTC | eekd$_{10}$kke | 62 | 34059 | 34074 | 1353 |
| 548111 | 1963 | 1978 | GACTGCATCTGAGCTT | eekd$_{10}$kke | 53 | 34062 | 34077 | 1354 |
| 548112 | 1965 | 1980 | GTGACTGCATCTGAGC | eekd$_{10}$kke | 23 | 34064 | 34079 | 1355 |
| 548113 | 1966 | 1981 | GGTGACTGCATCTGAG | eekd$_{10}$kke | 56 | 34065 | 34080 | 1356 |
| 548114 | 1967 | 1982 | TGGTGACTGCATCTGA | eekd$_{10}$kke | 70 | 34066 | 34081 | 1357 |
| 548115 | 1972 | 1987 | CATGCTGGTGACTGCA | eekd$_{10}$kke | 76 | 34071 | 34086 | 1358 |
| 548116 | 1973 | 1988 | TCATGCTGGTGACTGC | eekd$_{10}$kke | 3 | 34072 | 34087 | 1359 |
| 548117 | 1974 | 1989 | CTCATGCTGGTGACTG | eekd$_{10}$kke | 73 | 34073 | 34088 | 1360 |
| 548118 | 1975 | 1990 | TCTCATGCTGGTGACT | eekd$_{10}$kke | 47 | 34074 | 34089 | 1361 |
| 548119 | 1984 | 1999 | TGGACTGCTTCTCATG | eekd$_{10}$kke | 25 | 34083 | 34098 | 1362 |
| 548121 | 1986 | 2001 | TCTGGACTGCTTCTCA | eekd$_{10}$kke | 64 | 34085 | 34100 | 1363 |
| 548122 | 1987 | 2002 | CTCTGGACTGCTTCTC | eekd$_{10}$kke | 55 | 34086 | 34101 | 1364 |
| 548123 | 1990 | 2005 | AGACTCTGGACTGCTT | eekd$_{10}$kke | 49 | 34089 | 34104 | 1365 |
| 548124 | 1991 | 2006 | TAGACTCTGGACTGCT | eekd$_{10}$kke | 51 | 34090 | 34105 | 1366 |
| 548125 | 1992 | 2007 | CTAGACTCTGGACTGC | eekd$_{10}$kke | 89 | 34091 | 34106 | 1367 |
| 548126 | 1995 | 2010 | TGCCTAGACTCTGGAC | eekd$_{10}$kke | 19 | 34094 | 34109 | 1368 |
| 548127 | 1996 | 2011 | TTGCCTAGACTCTGGA | eekd$_{10}$kke | 60 | 34095 | 34110 | 1369 |
| 548128 | 1997 | 2012 | ATTGCCTAGACTCTGG | eekd$_{10}$kke | 55 | 34096 | 34111 | 1370 |
| 548129 | 2022 | 2037 | TTTGACTTGAACTCAG | eekd$_{10}$kke | 35 | 34121 | 34136 | 1371 |
| 548130 | 2023 | 2038 | ATTTGACTTGAACTCA | eekd$_{10}$kke | 27 | 34122 | 34137 | 1372 |
| 548131 | 2024 | 2039 | AATTTGACTTGAACTC | eekd$_{10}$kke | 45 | 34123 | 34138 | 1373 |
| 548132 | 2025 | 2040 | GAATTTGACTTGAACT | eekd$_{10}$kke | 0 | 34124 | 34139 | 1374 |
| 548133 | 2026 | 2041 | AGAATTTGACTTGAAC | eekd$_{10}$kke | 23 | 34125 | 34140 | 1375 |
| 548134 | 2027 | 2042 | CAGAATTTGACTTGAA | eekd$_{10}$kke | 17 | 34126 | 34141 | 1376 |

TABLE 19-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 548135 | 2028 | 2043 | TCAGAATTTGACTTGA | eekd$_{10}$kke | 46 | 34127 | 34142 | 1377 |
| 548136 | 2031 | 2046 | GGCTCAGAATTTGACT | eekd$_{10}$kke | 39 | 34130 | 34145 | 1378 |
| 548137 | 2032 | 2047 | AGGCTCAGAATTTGAC | eekd$_{10}$kke | 62 | 34131 | 34146 | 1379 |
| 548138 | 2036 | 2051 | CCCCAGGCTCAGAATT | eekd$_{10}$kke | 52 | 34135 | 34150 | 1380 |
| 548139 | 2047 | 2062 | AGATGAGGACCCCCCA | eekd$_{10}$kke | 56 | 34146 | 34161 | 1381 |
| 548140 | 2048 | 2063 | CAGATGAGGACCCCCC | eekd$_{10}$kke | 74 | 34147 | 34162 | 1382 |
| 548141 | 2049 | 2064 | GCAGATGAGGACCCCC | eekd$_{10}$kke | 66 | 34148 | 34163 | 1383 |
| 548142 | 2063 | 2078 | ACTCTCCATGCTTTGC | eekd$_{10}$kke | 44 | 34162 | 34177 | 1384 |
| 548143 | 2064 | 2079 | CACTCTCCATGCTTTG | eekd$_{10}$kke | 39 | 34163 | 34178 | 1385 |
| 548144 | 2068 | 2083 | ATGCCACTCTCCATGC | eekd$_{10}$kke | 52 | 34167 | 34182 | 1386 |
| 548145 | 2079 | 2094 | ATGCAAAGAAGATGCC | eekd$_{10}$kke | 63 | 34178 | 34193 | 1387 |
| 548146 | 2088 | 2103 | GTCCTTAGGATGCAAA | eekd$_{10}$kke | 68 | 34187 | 34202 | 1388 |
| 548147 | 2089 | 2104 | CGTCCTTAGGATGCAA | eekd$_{10}$kke | 81 | 34188 | 34203 | 1389 |
| 548148 | 2114 | 2129 | GCAGCTCTGAGTGCAC | eekd$_{10}$kke | 66 | 34213 | 34228 | 1390 |
| 548149 | 2127 | 2142 | GACATTGTCCTCAGCA | eekd$_{10}$kke | 39 | 34226 | 34241 | 1391 |
| 548150 | 2129 | 2144 | CAGACATTGTCCTCAG | eekd$_{10}$kke | 60 | 34228 | 34243 | 1392 |

TABLE 20

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 547747 | n/a | n/a | TCACTGTACTAGTTTC | eekd$_{10}$kke | 84 | 14746 14817 14888 14947 15007 15079 15222 15294 15353 15413 15485 15557 15615 15687 15817 15889 15947 | 14761 14832 14903 14962 15022 15094 15237 15309 15368 15428 15500 15572 15630 15702 15832 15904 15962 | 1267 |
| 547843 | 384 | 399 | CACTTATTTGATGACC | eekd$_{10}$kke | 83 | 9918 | 9933 | 1393 |
| 547844 | 385 | 400 | GCACTTATTTGATGAC | eekd$_{10}$kke | 13 | n/a | n/a | 1394 |
| 547845 | 394 | 409 | CGATGGCAAGCACTTA | eekd$_{10}$kke | 0 | n/a | n/a | 1395 |
| 547846 | 395 | 410 | TCGATGGCAAGCACTT | eekd$_{10}$kke | 0 | n/a | n/a | 1396 |
| 547847 | 396 | 411 | CTCGATGGCAAGCACT | eekd$_{10}$kke | 46 | n/a | n/a | 1397 |
| 547848 | 400 | 415 | ATGTCTCGATGGCAAG | eekd$_{10}$kke | 93 | 12656 | 12671 | 1398 |

TABLE 20-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 547849 | 401 | 416 | AATGTCTCGATGGCAA | eekd$_{10}$kke | 79 | 12657 | 12672 | 1399 |
| 547850 | 402 | 417 | AAATGTCTCGATGGCA | eekd$_{10}$kke | 51 | 12658 | 12673 | 1400 |
| 547851 | 403 | 418 | TAAATGTCTCGATGGC | eekd$_{10}$kke | 93 | 12659 | 12674 | 1401 |
| 547852 | 404 | 419 | ATAAATGTCTCGATGG | eekd$_{10}$kke | 67 | 12660 | 12675 | 1402 |
| 547853 | 405 | 420 | TATAAATGTCTCGATG | eekd$_{10}$kke | 0 | 12661 | 12676 | 1403 |
| 547854 | 416 | 431 | ATCAACTCCTTTATAA | eekd$_{10}$kke | 10 | 12672 | 12687 | 1404 |
| 547855 | 417 | 432 | TATCAACTCCTTTATA | eekd$_{10}$kke | 59 | 12673 | 12688 | 1405 |
| 547856 | 419 | 434 | CATATCAACTCCTTTA | eekd$_{10}$kke | 93 | 12675 | 12690 | 1406 |
| 547858 | 423 | 438 | CTCTCATATCAACTCC | eekd$_{10}$kke | 82 | 12679 | 12694 | 1407 |
| 547859 | 424 | 439 | CCTCTCATATCAACTC | eekd$_{10}$kke | 77 | 12680 | 12695 | 1408 |
| 547860 | 425 | 440 | TCCTCTCATATCAACT | eekd$_{10}$kke | 71 | 12681 | 12696 | 1409 |
| 547861 | 427 | 442 | ACTCCTCTCATATCAA | eekd$_{10}$kke | 0 | 12683 | 12698 | 1410 |
| 547862 | 428 | 443 | GACTCCTCTCATATCA | eekd$_{10}$kke | 22 | 12684 | 12699 | 1411 |
| 547863 | 429 | 444 | TGACTCCTCTCATATC | eekd$_{10}$kke | 73 | 12685 | 12700 | 1412 |
| 547864 | 430 | 445 | TTGACTCCTCTCATAT | eekd$_{10}$kke | 53 | 12686 | 12701 | 1413 |
| 547865 | 434 | 449 | AAAATTGACTCCTCTC | eekd$_{10}$kke | 3 | 12690 | 12705 | 1414 |
| 547866 | 436 | 451 | TTAAAATTGACTCCTC | eekd$_{10}$kke | 46 | 12692 | 12707 | 1415 |
| 547867 | 447 | 462 | CCTTAGACACATTAAA | eekd$_{10}$kke | 34 | 12703 | 12718 | 1416 |
| 547868 | 448 | 463 | ACCTTAGACACATTAA | eekd$_{10}$kke | 47 | 12704 | 12719 | 1417 |
| 547869 | 449 | 464 | AACCTTAGACACATTA | eekd$_{10}$kke | 45 | 12705 | 12720 | 1418 |
| 547870 | 451 | 466 | CTAACCTTAGACACAT | eekd$_{10}$kke | 89 | 12707 | 12722 | 1419 |
| 547871 | 452 | 467 | GCTAACCTTAGACACA | eekd$_{10}$kke | 96 | 12708 | 12723 | 1420 |
| 547872 | 453 | 468 | TGCTAACCTTAGACAC | eekd$_{10}$kke | 85 | 12709 | 12724 | 1421 |
| 547873 | 454 | 469 | CTGCTAACCTTAGACA | eekd$_{10}$kke | 77 | 12710 | 12725 | 1422 |
| 547874 | 455 | 470 | ACTGCTAACCTTAGAC | eekd$_{10}$kke | 70 | 12711 | 12726 | 1423 |
| 547875 | 456 | 471 | CACTGCTAACCTTAGA | eekd$_{10}$kke | 73 | 12712 | 12727 | 1424 |
| 547876 | 457 | 472 | ACACTGCTAACCTTAG | eekd$_{10}$kke | 78 | 12713 | 12728 | 1425 |
| 547877 | 458 | 473 | AACACTGCTAACCTTA | eekd$_{10}$kke | 81 | 12714 | 12729 | 1426 |
| 547879 | 460 | 475 | TCAACACTGCTAACCT | eekd$_{10}$kke | 69 | 12716 | 12731 | 1427 |
| 547880 | 461 | 476 | TTCAACACTGCTAACC | eekd$_{10}$kke | 69 | 12717 | 12732 | 1428 |
| 547881 | 465 | 480 | ATTCTTCAACACTGCT | eekd$_{10}$kke | 0 | 12721 | 12736 | 1429 |
| 547882 | 500 | 515 | CTGGCAGCGAATGTTA | eekd$_{10}$kke | 91 | 12756 | 12771 | 1430 |
| 547883 | 501 | 516 | ACTGGCAGCGAATGTT | eekd$_{10}$kke | 99 | 12757 | 12772 | 1431 |
| 547884 | 518 | 533 | CGTGGCATATGAAAAA | eekd$_{10}$kke | 87 | 12774 | 12789 | 1432 |
| 547885 | 539 | 554 | CTCTGCCTTGTGAAAT | eekd$_{10}$kke | 45 | 12795 | 12810 | 1433 |
| 547886 | 544 | 559 | CGGTACTCTGCCTTGT | eekd$_{10}$kke | 97 | 12800 | 12815 | 1434 |

TABLE 20-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 547889 | 547 | 562 | TTCCGGTACTCTGCCT | eekd$_{10}$kke | 91 | n/a | n/a | 1435 |
| 547890 | 550 | 565 | TTGTTCCGGTACTCTG | eekd$_{10}$kke | 97 | n/a | n/a | 1436 |
| 547891 | 551 | 566 | ATTGTTCCGGTACTCT | eekd$_{10}$kke | 84 | n/a | n/a | 1437 |
| 547892 | 553 | 568 | CAATTGTTCCGGTACT | eekd$_{10}$kke | 29 | n/a | n/a | 1438 |
| 547893 | 554 | 569 | GCAATTGTTCCGGTAC | eekd$_{10}$kke | 81 | n/a | n/a | 1439 |
| 547894 | 555 | 570 | GGCAATTGTTCCGGTA | eekd$_{10}$kke | 92 | n/a | n/a | 1440 |
| 547898 | 563 | 578 | CTTTAATAGGCAATTG | eekd$_{10}$kke | 0 | 14134 | 14149 | 1441 |
| 547899 | 566 | 581 | GTACTTTAATAGGCAA | eekd$_{10}$kke | 49 | 14137 | 14152 | 1442 |
| 547900 | 567 | 582 | TGTACTTTAATAGGCA | eekd$_{10}$kke | 93 | 14138 | 14153 | 1443 |
| 547901 | 568 | 583 | CTGTACTTTAATAGGC | eekd$_{10}$kke | 77 | 14139 | 14154 | 1444 |
| 547902 | 569 | 584 | ACTGTACTTTAATAGG | eekd$_{10}$kke | 20 | 14140 | 14155 | 1445 |
| 547903 | 604 | 619 | CTCAGCACCTTTATAG | eekd$_{10}$kke | 62 | 14175 | 14190 | 1446 |
| 547904 | 605 | 620 | ACTCAGCACCTTTATA | eekd$_{10}$kke | 56 | 14176 | 14191 | 1447 |
| 547905 | 606 | 621 | TACTCAGCACCTTTAT | eekd$_{10}$kke | 20 | 14177 | 14192 | 1448 |
| 547906 | 607 | 622 | TTACTCAGCACCTTTA | eekd$_{10}$kke | 59 | 14178 | 14193 | 1449 |
| 547907 | 652 | 667 | ATTTCTGAAAGGGCAC | eekd$_{10}$kke | 27 | 14223 | 14238 | 1450 |
| 547908 | 654 | 669 | CAATTTCTGAAAGGGC | eekd$_{10}$kke | 94 | 14225 | 14240 | 1451 |
| 547909 | 655 | 670 | CCAATTTCTGAAAGGG | eekd$_{10}$kke | 82 | 14226 | 14241 | 1452 |
| 547910 | 656 | 671 | ACCAATTTCTGAAAGG | eekd$_{10}$kke | 26 | 14227 | 14242 | 1453 |
| 547911 | 661 | 676 | TGGCAACCAATTTCTG | eekd$_{10}$kke | 0 | n/a | n/a | 1454 |
| 547912 | 701 | 716 | ATCCACATCTGAGAAC | eekd$_{10}$kke | 23 | 26149 | 26164 | 1455 |
| 547913 | 706 | 721 | GCAACATCCACATCTG | eekd$_{10}$kke | 71 | 26154 | 26169 | 1456 |
| 547914 | 707 | 722 | GGCAACATCCACATCT | eekd$_{10}$kke | 74 | 26155 | 26170 | 1457 |
| 547915 | 708 | 723 | TGGCAACATCCACATC | eekd$_{10}$kke | 0 | 26156 | 26171 | 1458 |
| 547916 | 710 | 725 | CCTGGCAACATCCACA | eekd$_{10}$kke | 70 | 26158 | 26173 | 1459 |
| 547917 | 712 | 727 | ACCCTGGCAACATCCA | eekd$_{10}$kke | 33 | 26160 | 26175 | 1460 |
| 547918 | 713 | 728 | AACCCTGGCAACATCC | eekd$_{10}$kke | 1 | 26161 | 26176 | 1461 |
| 547919 | 714 | 729 | GAACCCTGGCAACATC | eekd$_{10}$kke | 41 | 26162 | 26177 | 1462 |

TABLE 21

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 531231 | n/a | n/a | TATCACTGTACTAGTTTCCT | eeeeed$_{10}$eeeee | 62 | 14744 | 14763 | 334 |
| | | | | | | 14815 | 14834 | |
| | | | | | | 14886 | 14905 | |
| | | | | | | 14945 | 14964 | |
| | | | | | | 15005 | 15024 | |

TABLE 21-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| | | | | | | 15077 | 15096 | |
| | | | | | | 15220 | 15239 | |
| | | | | | | 15292 | 15311 | |
| | | | | | | 15351 | 15370 | |
| | | | | | | 15411 | 15430 | |
| | | | | | | 15483 | 15502 | |
| | | | | | | 15555 | 15574 | |
| | | | | | | 15613 | 15632 | |
| | | | | | | 15685 | 15704 | |
| | | | | | | 15815 | 15834 | |
| | | | | | | 15887 | 15906 | |
| | | | | | | 15945 | 15964 | |
| 547747 | n/a | n/a | TCACTGTACTAGTTTC | eekd$_{10}$kke | 88 | 14746 | 14761 | 1267 |
| | | | | | | 14817 | 14832 | |
| | | | | | | 14888 | 14903 | |
| | | | | | | 14947 | 14962 | |
| | | | | | | 15007 | 15022 | |
| | | | | | | 15079 | 15094 | |
| | | | | | | 15222 | 15237 | |
| | | | | | | 15294 | 15309 | |
| | | | | | | 15353 | 15368 | |
| | | | | | | 15413 | 15428 | |
| | | | | | | 15485 | 15500 | |
| | | | | | | 15557 | 15572 | |
| | | | | | | 15615 | 15630 | |
| | | | | | | 15687 | 15702 | |
| | | | | | | 15817 | 15832 | |
| | | | | | | 15889 | 15904 | |
| | | | | | | 15947 | 15962 | |
| 547751 | 7 | 22 | TGAACGGTCTTCAAGC | eekd$_{10}$kke | 0 | 3399 | 3414 | 1463 |
| 547753 | 8 | 23 | ATGAACGGTCTTCAAG | eekd$_{10}$kke | 3 | 3400 | 3415 | 1464 |
| 547755 | 13 | 28 | TAAAAATGAACGGTCT | eekd$_{10}$kke | 0 | 3405 | 3420 | 1465 |
| 547757 | 28 | 43 | GAGTCTCTTGTCACTT | eekd$_{10}$kke | 69 | 3420 | 3435 | 1466 |
| 547759 | 29 | 44 | TGAGTCTCTTGTCACT | eekd$_{10}$kke | 73 | 3421 | 3436 | 1467 |
| 547763 | 31 | 46 | GGTGAGTCTCTTGTCA | eekd$_{10}$kke | 66 | 3423 | 3438 | 1468 |
| 547765 | 32 | 47 | AGGTGAGTCTCTTGTC | eekd$_{10}$kke | 20 | 3424 | 3439 | 1469 |
| 547767 | 35 | 50 | TGGAGGTGAGTCTCTT | eekd$_{10}$kke | 74 | 3427 | 3442 | 1470 |
| 547769 | 36 | 51 | TTGGAGGTGAGTCTCT | eekd$_{10}$kke | 81 | 3428 | 3443 | 1471 |
| 547771 | 37 | 52 | CTTGGAGGTGAGTCTC | eekd$_{10}$kke | 60 | 3429 | 3444 | 1472 |
| 547773 | 38 | 53 | TCTTGGAGGTGAGTCT | eekd$_{10}$kke | 47 | 3430 | 3445 | 1473 |
| 547777 | 43 | 58 | TTGCTTCTTGGAGGTG | eekd$_{10}$kke | 69 | 3435 | 3450 | 1474 |
| 547779 | 44 | 59 | ATTGCTTCTTGGAGGT | eekd$_{10}$kke | 41 | 3436 | 3451 | 1475 |
| 547781 | 46 | 61 | CAATTGCTTCTTGGAG | eekd$_{10}$kke | 49 | 3438 | 3453 | 1476 |
| 547783 | 48 | 63 | CACAATTGCTTCTTGG | eekd$_{10}$kke | 48 | 3440 | 3455 | 1477 |
| 547784 | 72 | 87 | GCTTGAATAAAATCAT | eekd$_{10}$kke | 46 | 4071 | 4086 | 1478 |
| 547785 | 79 | 94 | GTTGCTTGCTTGAATA | eekd$_{10}$kke | 48 | 4078 | 4093 | 1479 |
| 547786 | 80 | 95 | AGTTGCTTGCTTGAAT | eekd$_{10}$kke | 44 | 4079 | 4094 | 1480 |
| 547787 | 81 | 96 | AAGTTGCTTGCTTGAA | eekd$_{10}$kke | 22 | 4080 | 4095 | 1481 |
| 547788 | 82 | 97 | TAAGTTGCTTGCTTGA | eekd$_{10}$kke | 49 | 4081 | 4096 | 1482 |
| 547789 | 86 | 101 | GAAATAAGTTGCTTGC | eekd$_{10}$kke | 20 | 4085 | 4100 | 1483 |

TABLE 21-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 547790 | 87 | 102 | TGAAATAAGTTGCTTG | eekd$_{10}$kke | 23 | 4086 | 4101 | 1484 |
| 547791 | 106 | 121 | ACTGTAGCAAACAAGG | eekd$_{10}$kke | 49 | 4105 | 4120 | 1485 |
| 547792 | 116 | 131 | TCCACAGGAAACTGTA | eekd$_{10}$kke | 31 | n/a | n/a | 1486 |
| 547793 | 117 | 132 | ATCCACAGGAAACTGT | eekd$_{10}$kke | 16 | n/a | n/a | 1487 |
| 547794 | 136 | 151 | TCATAGAGTTGAGTCA | eekd$_{10}$kke | 49 | 8008 | 8023 | 1488 |
| 547795 | 155 | 170 | ACCTCTGAAGAAGGCG | eekd$_{10}$kke | 66 | 8027 | 8042 | 1489 |
| 547796 | 161 | 176 | ATCCCCACCTCTGAAG | eekd$_{10}$kke | 35 | 8033 | 8048 | 1490 |
| 547797 | 167 | 182 | AGCTACATCCCCACCT | eekd$_{10}$kke | 33 | 8039 | 8054 | 1491 |
| 547799 | 169 | 184 | GAAGCTACATCCCCAC | eekd$_{10}$kke | 41 | 8041 | 8056 | 1492 |
| 547800 | 174 | 189 | ACATGGAAGCTACATC | eekd$_{10}$kke | 20 | 8046 | 8061 | 1493 |
| 547801 | 175 | 190 | TACATGGAAGCTACAT | eekd$_{10}$kke | 11 | 8047 | 8062 | 1494 |
| 547802 | 176 | 191 | GTACATGGAAGCTACA | eekd$_{10}$kke | 41 | 8048 | 8063 | 1495 |
| 547803 | 177 | 192 | TGTACATGGAAGCTAC | eekd$_{10}$kke | 0 | 8049 | 8064 | 1496 |
| 547804 | 178 | 193 | GTGTACATGGAAGCTA | eekd$_{10}$kke | 22 | 8050 | 8065 | 1497 |
| 547805 | 180 | 195 | GGGTGTACATGGAAGC | eekd$_{10}$kke | 54 | 8052 | 8067 | 1498 |
| 547807 | 197 | 212 | GCAGTATTGGGCATTT | eekd$_{10}$kke | 75 | 8069 | 8084 | 1499 |
| 547808 | 203 | 218 | CATCTGGCAGTATTGG | eekd$_{10}$kke | 56 | 8075 | 8090 | 1500 |
| 547809 | 204 | 219 | TCATCTGGCAGTATTG | eekd$_{10}$kke | 33 | 8076 | 8091 | 1501 |
| 547810 | 206 | 221 | CCTCATCTGGCAGTAT | eekd$_{10}$kke | 60 | 8078 | 8093 | 1502 |
| 547811 | 207 | 222 | ACCTCATCTGGCAGTA | eekd$_{10}$kke | 49 | 8079 | 8094 | 1503 |
| 547812 | 211 | 226 | GTGCACCTCATCTGGC | eekd$_{10}$kke | 51 | 8083 | 8098 | 1504 |
| 547813 | 219 | 234 | GGTGGAATGTGCACCT | eekd$_{10}$kke | 34 | 8091 | 8106 | 1505 |
| 547814 | 220 | 235 | GGGTGGAATGTGCACC | eekd$_{10}$kke | 60 | 8092 | 8107 | 1506 |
| 547815 | 255 | 270 | AACTTGCTGGAAGAAA | eekd$_{10}$kke | 3 | 8127 | 8142 | 1507 |
| 547816 | 256 | 271 | GAACTTGCTGGAAGAA | eekd$_{10}$kke | 45 | 8128 | 8143 | 1508 |
| 547817 | 257 | 272 | TGAACTTGCTGGAAGA | eekd$_{10}$kke | 18 | 8129 | 8144 | 1509 |
| 547818 | 260 | 275 | GATTGAACTTGCTGGA | eekd$_{10}$kke | 4 | 8132 | 8147 | 1510 |
| 547819 | 264 | 279 | CATTGATTGAACTTGC | eekd$_{10}$kke | 11 | 8136 | 8151 | 1511 |
| 547820 | 265 | 280 | TCATTGATTGAACTTG | eekd$_{10}$kke | 0 | 8137 | 8152 | 1512 |
| 547821 | 282 | 297 | CAAACCTTTTCTCCAT | eekd$_{10}$kke | 44 | n/a | n/a | 1513 |
| 547822 | 287 | 302 | GCAACCAAACCTTTTC | eekd$_{10}$kke | 71 | n/a | n/a | 1514 |
| 547823 | 288 | 303 | AGCAACCAAACCTTTT | eekd$_{10}$kke | 51 | n/a | n/a | 1515 |
| 547824 | 331 | 346 | CGATGTACTTTTGGCA | eekd$_{10}$kke | 82 | 9865 | 9880 | 1516 |
| 547825 | 332 | 347 | TCGATGTACTTTTGGC | eekd$_{10}$kke | 59 | 9866 | 9881 | 1517 |
| 547826 | 333 | 348 | TTCGATGTACTTTTGG | eekd$_{10}$kke | 31 | 9867 | 9882 | 1518 |
| 547827 | 334 | 349 | GTTCGATGTACTTTTG | eekd$_{10}$kke | 47 | 9868 | 9883 | 1519 |
| 547828 | 337 | 352 | CCTGTTCGATGTACTT | eekd$_{10}$kke | 63 | 9871 | 9886 | 1520 |

TABLE 21-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 547829 | 338 | 353 | ACCTGTTCGATGTACT | eekd$_{10}$kke | 59 | 9872 | 9887 | 1521 |
| 547830 | 340 | 355 | GCACCTGTTCGATGTA | eekd$_{10}$kke | 74 | 9874 | 9889 | 1522 |
| 547831 | 342 | 357 | CTGCACCTGTTCGATG | eekd$_{10}$kke | 49 | 9876 | 9891 | 1523 |
| 547832 | 343 | 358 | ACTGCACCTGTTCGAT | eekd$_{10}$kke | 59 | 9877 | 9892 | 1524 |
| 547833 | 344 | 359 | AACTGCACCTGTTCGA | eekd$_{10}$kke | 40 | 9878 | 9893 | 1525 |
| 547834 | 345 | 360 | AAACTGCACCTGTTCG | eekd$_{10}$kke | 63 | 9879 | 9894 | 1526 |
| 547835 | 349 | 364 | CCAGAAACTGCACCTG | eekd$_{10}$kke | 81 | 9883 | 9898 | 1527 |
| 547836 | 350 | 365 | TCCAGAAACTGCACCT | eekd$_{10}$kke | 50 | 9884 | 9899 | 1528 |
| 547837 | 352 | 367 | TGTCCAGAAACTGCAC | eekd$_{10}$kke | 51 | 9886 | 9901 | 1529 |
| 547838 | 362 | 377 | CTTCAAGGAATGTCCA | eekd$_{10}$kke | 45 | 9896 | 9911 | 1530 |
| 547839 | 363 | 378 | GCTTCAAGGAATGTCC | eekd$_{10}$kke | 35 | 9897 | 9912 | 1531 |
| 547840 | 365 | 380 | TTGCTTCAAGGAATGT | eekd$_{10}$kke | 36 | 9899 | 9914 | 1532 |
| 547841 | 369 | 384 | CACATTGCTTCAAGGA | eekd$_{10}$kke | 42 | 9903 | 9918 | 1533 |
| 547842 | 375 | 390 | GATGACCACATTGCTT | eekd$_{10}$kke | 10 | 9909 | 9924 | 1534 |

TABLE 22

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 531231 | n/a | n/a | TATCACTGTACTAGTTTCCT | eeeeed$_{10}$eeeee | 75 | 14744 14815 14886 14945 15005 15077 15220 15292 15351 15411 15483 15555 15613 15685 15815 15887 15945 | 14763 14834 14905 14964 15024 15096 15239 15311 15370 15430 15502 15574 15632 15704 15834 15906 15964 | 334 |
| 547747 | n/a | n/a | TCACTGTACTAGTTTC | eekd$_{10}$kke | 91 | 14746 14817 14888 14947 15007 15079 15222 15294 15353 15413 15485 15557 15615 15687 | 14761 14832 14903 14962 15022 15094 15237 15309 15368 15428 15500 15572 15630 15702 | 1267 |

TABLE 22-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| | | | | | | 15817 | 15832 | |
| | | | | | | 15889 | 15904 | |
| | | | | | | 15947 | 15962 | |
| 547843 | 384 | 399 | CACTTATTTGATGACC | eekd$_{10}$kke | 83 | 9918 | 9933 | 1393 |
| 547844 | 385 | 400 | GCACTTATTTGATGAC | eekd$_{10}$kke | 76 | n/a | n/a | 1394 |
| 547845 | 394 | 409 | CGATGGCAAGCACTTA | eekd$_{10}$kke | 64 | n/a | n/a | 1395 |
| 547846 | 395 | 410 | TCGATGGCAAGCACTT | eekd$_{10}$kke | 42 | n/a | n/a | 1396 |
| 547847 | 396 | 411 | CTCGATGGCAAGCACT | eekd$_{10}$kke | 72 | n/a | n/a | 1397 |
| 547848 | 400 | 415 | ATGTCTCGATGGCAAG | eekd$_{10}$kke | 79 | 12656 | 12671 | 1398 |
| 547849 | 401 | 416 | AATGTCTCGATGGCAA | eekd$_{10}$kke | 90 | 12657 | 12672 | 1399 |
| 547850 | 402 | 417 | AAATGTCTCGATGGCA | eekd$_{10}$kke | 80 | 12658 | 12673 | 1400 |
| 547851 | 403 | 418 | TAAATGTCTCGATGGC | eekd$_{10}$kke | 84 | 12659 | 12674 | 1401 |
| 547852 | 404 | 419 | ATAAATGTCTCGATGG | eekd$_{10}$kke | 66 | 12660 | 12675 | 1402 |
| 547853 | 405 | 420 | TATAAATGTCTCGATG | eekd$_{10}$kke | 30 | 12661 | 12676 | 1403 |
| 547854 | 416 | 431 | ATCAACTCCTTTATAA | eekd$_{10}$kke | 9 | 12672 | 12687 | 1404 |
| 547855 | 417 | 432 | TATCAACTCCTTTATA | eekd$_{10}$kke | 38 | 12673 | 12688 | 1405 |
| 547856 | 419 | 434 | CATATCAACTCCTTTA | eekd$_{10}$kke | 51 | 12675 | 12690 | 1406 |
| 547857 | 421 | 436 | CTCATATCAACTCCTT | eekd$_{10}$kke | 84 | 12677 | 12692 | 1535 |
| 547858 | 423 | 438 | CTCTCATATCAACTCC | eekd$_{10}$kke | 76 | 12679 | 12694 | 1407 |
| 547859 | 424 | 439 | CCTCTCATATCAACTC | eekd$_{10}$kke | 88 | 12680 | 12695 | 1408 |
| 547860 | 425 | 440 | TCCTCTCATATCAACT | eekd$_{10}$kke | 70 | 12681 | 12696 | 1409 |
| 547861 | 427 | 442 | ACTCCTCTCATATCAA | eekd$_{10}$kke | 57 | 12683 | 12698 | 1410 |
| 547862 | 428 | 443 | GACTCCTCTCATATCA | eekd$_{10}$kke | 88 | 12684 | 12699 | 1411 |
| 547863 | 429 | 444 | TGACTCCTCTCATATC | eekd$_{10}$kke | 77 | 12685 | 12700 | 1412 |
| 547864 | 430 | 445 | TTGACTCCTCTCATAT | eekd$_{10}$kke | 73 | 12686 | 12701 | 1413 |
| 547865 | 434 | 449 | AAAATTGACTCCTCTC | eekd$_{10}$kke | 61 | 12690 | 12705 | 1414 |
| 547866 | 436 | 451 | TTAAAATTGACTCCTC | eekd$_{10}$kke | 40 | 12692 | 12707 | 1415 |
| 547867 | 447 | 462 | CCTTAGACACATTAAA | eekd$_{10}$kke | 53 | 12703 | 12718 | 1416 |
| 547868 | 448 | 463 | ACCTTAGACACATTAA | eekd$_{10}$kke | 71 | 12704 | 12719 | 1417 |
| 547869 | 449 | 464 | AACCTTAGACACATTA | eekd$_{10}$kke | 77 | 12705 | 12720 | 1418 |
| 547870 | 451 | 466 | CTAACCTTAGACACAT | eekd$_{10}$kke | 83 | 12707 | 12722 | 1419 |
| 547871 | 452 | 467 | GCTAACCTTAGACACA | eekd$_{10}$kke | 77 | 12708 | 12723 | 1420 |
| 547872 | 453 | 468 | TGCTAACCTTAGACAC | eekd$_{10}$kke | 73 | 12709 | 12724 | 1421 |
| 547873 | 454 | 469 | CTGCTAACCTTAGACA | eekd$_{10}$kke | 82 | 12710 | 12725 | 1422 |
| 547874 | 455 | 470 | ACTGCTAACCTTAGAC | eekd$_{10}$kke | 60 | 12711 | 12726 | 1423 |
| 547875 | 456 | 471 | CACTGCTAACCTTAGA | eekd$_{10}$kke | 57 | 12712 | 12727 | 1424 |
| 547876 | 457 | 472 | ACACTGCTAACCTTAG | eekd$_{10}$kke | 59 | 12713 | 12728 | 1425 |
| 547877 | 458 | 473 | AACACTGCTAACCTTA | eekd$_{10}$kke | 93 | 12714 | 12729 | 1426 |

TABLE 22-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 547878 | 459 | 474 | CAACACTGCTAACCTT | eekd$_{10}$kke | 62 | 12715 | 12730 | 1536 |
| 547879 | 460 | 475 | TCAACACTGCTAACCT | eekd$_{10}$kke | 65 | 12716 | 12731 | 1427 |
| 547880 | 461 | 476 | TTCAACACTGCTAACC | eekd$_{10}$kke | 59 | 12717 | 12732 | 1428 |
| 547881 | 465 | 480 | ATTCTTCAACACTGCT | eekd$_{10}$kke | 50 | 12721 | 12736 | 1429 |
| 547882 | 500 | 515 | CTGGCAGCGAATGTTA | eekd$_{10}$kke | 96 | 12756 | 12771 | 1430 |
| 547883 | 501 | 516 | ACTGGCAGCGAATGTT | eekd$_{10}$kke | 0 | 12757 | 12772 | 1431 |
| 547884 | 518 | 533 | CGTGGCATATGAAAAA | eekd$_{10}$kke | 49 | 12774 | 12789 | 1432 |
| 547885 | 539 | 554 | CTCTGCCTTGTGAAAT | eekd$_{10}$kke | 57 | 12795 | 12810 | 1433 |
| 547886 | 544 | 559 | CGGTACTCTGCCTTGT | eekd$_{10}$kke | 89 | 12800 | 12815 | 1434 |
| 547887 | 545 | 560 | CCGGTACTCTGCCTTG | eekd$_{10}$kke | 99 | 12801 | 12816 | 1537 |
| 547888 | 546 | 561 | TCCGGTACTCTGCCTT | eekd$_{10}$kke | 99 | n/a | n/a | 1538 |
| 547889 | 547 | 562 | TTCCGGTACTCTGCCT | eekd$_{10}$kke | 97 | n/a | n/a | 1435 |
| 547890 | 550 | 565 | TTGTTCCGGTACTCTG | eekd$_{10}$kke | 90 | n/a | n/a | 1436 |
| 547891 | 551 | 566 | ATTGTTCCGGTACTCT | eekd$_{10}$kke | 88 | n/a | n/a | 1437 |
| 547892 | 553 | 568 | CAATTGTTCCGGTACT | eekd$_{10}$kke | 28 | n/a | n/a | 1438 |
| 547893 | 554 | 569 | GCAATTGTTCCGGTAC | eekd$_{10}$kke | 80 | n/a | n/a | 1439 |
| 547894 | 555 | 570 | GGCAATTGTTCCGGTA | eekd$_{10}$kke | 91 | n/a | n/a | 1440 |
| 547895 | 556 | 571 | AGGCAATTGTTCCGGT | eekd$_{10}$kke | 94 | n/a | n/a | 1539 |
| 547896 | 557 | 572 | TAGGCAATTGTTCCGG | eekd$_{10}$kke | 95 | n/a | n/a | 1540 |
| 547897 | 558 | 573 | ATAGGCAATTGTTCCG | eekd$_{10}$kke | 82 | n/a | n/a | 1541 |
| 547898 | 563 | 578 | CTTTAATAGGCAATTG | eekd$_{10}$kke | 28 | 14134 | 14149 | 1441 |
| 547899 | 566 | 581 | GTACTTTAATAGGCAA | eekd$_{10}$kke | 68 | 14137 | 14152 | 1442 |
| 547900 | 567 | 582 | TGTACTTTAATAGGCA | eekd$_{10}$kke | 68 | 14138 | 14153 | 1443 |
| 547901 | 568 | 583 | CTGTACTTTAATAGGC | eekd$_{10}$kke | 85 | 14139 | 14154 | 1444 |
| 547902 | 569 | 584 | ACTGTACTTTAATAGG | eekd$_{10}$kke | 33 | 14140 | 14155 | 1445 |
| 547903 | 604 | 619 | CTCAGCACCTTTATAG | eekd$_{10}$kke | 6 | 14175 | 14190 | 1446 |
| 547904 | 605 | 620 | ACTCAGCACCTTTATA | eekd$_{10}$kke | 41 | 14176 | 14191 | 1447 |
| 547905 | 606 | 621 | TACTCAGCACCTTTAT | eekd$_{10}$kke | 59 | 14177 | 14192 | 1448 |
| 547906 | 607 | 622 | TTACTCAGCACCTTTA | eekd$_{10}$kke | 70 | 14178 | 14193 | 1449 |
| 547907 | 652 | 667 | ATTTCTGAAAGGGCAC | eekd$_{10}$kke | 27 | 14223 | 14238 | 1450 |
| 547908 | 654 | 669 | CAATTTCTGAAAGGGC | eekd$_{10}$kke | 71 | 14225 | 14240 | 1451 |
| 547909 | 655 | 670 | CCAATTTCTGAAAGGG | eekd$_{10}$kke | 51 | 14226 | 14241 | 1452 |
| 547910 | 656 | 671 | ACCAATTTCTGAAAGG | eekd$_{10}$kke | 34 | 14227 | 14242 | 1453 |
| 547911 | 661 | 676 | TGGCAACCAATTTCTG | eekd$_{10}$kke | 15 | n/a | n/a | 1454 |
| 547912 | 701 | 716 | ATCCACATCTGAGAAC | eekd$_{10}$kke | 53 | 26149 | 26164 | 1455 |
| 547913 | 706 | 721 | GCAACATCCACATCTG | eekd$_{10}$kke | 61 | 26154 | 26169 | 1456 |

TABLE 22-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 547914 | 707 | 722 | GGCAACATCCACATCT | eekd$_{10}$kke | 63 | 26155 | 26170 | 1457 |
| 547915 | 708 | 723 | TGGCAACATCCACATC | eekd$_{10}$kke | 62 | 26156 | 26171 | 1458 |
| 547916 | 710 | 725 | CCTGGCAACATCCACA | eekd$_{10}$kke | 56 | 26158 | 26173 | 1459 |
| 547917 | 712 | 727 | ACCCTGGCAACATCCA | eekd$_{10}$kke | 54 | 26160 | 26175 | 1460 |
| 547918 | 713 | 728 | AACCCTGGCAACATCC | eekd$_{10}$kke | 65 | 26161 | 26176 | 1461 |
| 547919 | 714 | 729 | GAACCCTGGCAACATC | eekd$_{10}$kke | 73 | 26162 | 26177 | 1462 |

TABLE 23

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 531231 | n/a | n/a | TATCACTGTACTAGTTTCCT | eeeeed$_{10}$eeeee | 16 | 14744<br>14815<br>14886<br>14945<br>15005<br>15077<br>15220<br>15292<br>15351<br>15411<br>15483<br>15555<br>15613<br>15685<br>15815<br>15887<br>15945 | 14763<br>14834<br>14905<br>14964<br>15024<br>15096<br>15239<br>15311<br>15370<br>15430<br>15502<br>15574<br>15632<br>15704<br>15834<br>15906<br>15964 | 334 |
| 547747 | n/a | n/a | TCACTGTACTAGTTTC | eekd$_{10}$kke | 83 | 14746<br>14817<br>14888<br>14947<br>15007<br>15079<br>15222<br>15294<br>15353<br>15413<br>15485<br>15557<br>15615<br>15687<br>15817<br>15889<br>15947 | 14761<br>14832<br>14903<br>14962<br>15022<br>15094<br>15237<br>15309<br>15368<br>15428<br>15500<br>15572<br>15630<br>15702<br>15832<br>15904<br>15962 | 1267 |
| 547920 | 716 | 731 | GAGAACCCTGGCAACA | eekd$_{10}$kke | 52 | 26164 | 26179 | 1542 |
| 547921 | 717 | 732 | TGAGAACCCTGGCAAC | eekd$_{10}$kke | 43 | 26165 | 26180 | 1543 |
| 547922 | 722 | 737 | TGGAGTGAGAACCCTG | eekd$_{10}$kke | 79 | 26170 | 26185 | 1544 |
| 547923 | 725 | 740 | ATCTGGAGTGAGAACC | eekd$_{10}$kke | 68 | 26173 | 26188 | 1545 |
| 547924 | 742 | 757 | GTCCGACACACAAAAG | eekd$_{10}$kke | 53 | 26190 | 26205 | 1546 |
| 547925 | 743 | 758 | GGTCCGACACACAAAA | eekd$_{10}$kke | 16 | 26191 | 26206 | 1547 |
| 547927 | 745 | 760 | ATGGTCCGACACACAA | eekd$_{10}$kke | 79 | 26193 | 26208 | 1548 |

TABLE 23-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 547928 | 746 | 761 | GATGGTCCGACACACA | eekd$_{10}$kke | 70 | 26194 | 26209 | 1549 |
| 547929 | 747 | 762 | AGATGGTCCGACACAC | eekd$_{10}$kke | 65 | 26195 | 26210 | 1550 |
| 547930 | 757 | 772 | TGATAGGTGCAGATGG | eekd$_{10}$kke | 48 | 26205 | 26220 | 1551 |
| 547931 | 758 | 773 | GTGATAGGTGCAGATG | eekd$_{10}$kke | 58 | 26206 | 26221 | 1552 |
| 547932 | 804 | 819 | CGATTTTCCATACATT | eekd$_{10}$kke | 33 | 26252 | 26267 | 1553 |
| 547933 | 805 | 820 | TCGATTTTCCATACAT | eekd$_{10}$kke | 44 | 26253 | 26268 | 1554 |
| 547934 | 806 | 821 | CTCGATTTTCCATACA | eekd$_{10}$kke | 38 | 26254 | 26269 | 1555 |
| 547935 | 807 | 822 | ACTCGATTTTCCATAC | eekd$_{10}$kke | 27 | 26255 | 26270 | 1556 |
| 547936 | 808 | 823 | GACTCGATTTTCCATA | eekd$_{10}$kke | 44 | 26256 | 26271 | 1557 |
| 547937 | 811 | 826 | TGTGACTCGATTTTCC | eekd$_{10}$kke | 56 | 26259 | 26274 | 1558 |
| 547938 | 812 | 827 | TTGTGACTCGATTTTC | eekd$_{10}$kke | 56 | 26260 | 26275 | 1559 |
| 547939 | 813 | 828 | TTTGTGACTCGATTTT | eekd$_{10}$kke | 70 | 26261 | 26276 | 1560 |
| 547940 | 817 | 832 | TTTCTTTGTGACTCGA | eekd$_{10}$kke | 71 | n/a | n/a | 1561 |
| 547941 | 852 | 867 | GTGTGCCACTTTCAGA | eekd$_{10}$kke | 66 | 27116 | 27131 | 1562 |
| 547942 | 853 | 868 | GGTGTGCCACTTTCAG | eekd$_{10}$kke | 85 | 27117 | 27132 | 1563 |
| 547943 | 854 | 869 | TGGTGTGCCACTTTCA | eekd$_{10}$kke | 83 | 27118 | 27133 | 1564 |
| 547944 | 857 | 872 | ACTTGGTGTGCCACTT | eekd$_{10}$kke | 54 | 27121 | 27136 | 1565 |
| 547945 | 858 | 873 | AACTTGGTGTGCCACT | eekd$_{10}$kke | 62 | 27122 | 27137 | 1566 |
| 547946 | 859 | 874 | GAACTTGGTGTGCCAC | eekd$_{10}$kke | 81 | 27123 | 27138 | 1567 |
| 547947 | 860 | 875 | GGAACTTGGTGTGCCA | eekd$_{10}$kke | 80 | 27124 | 27139 | 1568 |
| 547948 | 861 | 876 | AGGAACTTGGTGTGCC | eekd$_{10}$kke | 77 | 27125 | 27140 | 1569 |
| 547949 | 880 | 895 | GTGTTTTCTTGAGGAG | eekd$_{10}$kke | 6 | 27144 | 27159 | 1570 |
| 547950 | 881 | 896 | GGTGTTTTCTTGAGGA | eekd$_{10}$kke | 49 | 27145 | 27160 | 1571 |
| 547951 | 887 | 902 | AGATATGGTGTTTTCT | eekd$_{10}$kke | 25 | 27151 | 27166 | 1572 |
| 547952 | 888 | 903 | CAGATATGGTGTTTTC | eekd$_{10}$kke | 46 | 27152 | 27167 | 1573 |
| 547953 | 895 | 910 | CTATATCCAGATATGG | eekd$_{10}$kke | 16 | 27159 | 27174 | 1574 |
| 547954 | 902 | 917 | TAAAAGGCTATATCCA | eekd$_{10}$kke | 36 | 27166 | 27181 | 1575 |
| 547956 | 904 | 919 | GTTAAAAGGCTATATC | eekd$_{10}$kke | 13 | 27168 | 27183 | 1576 |
| 547957 | 905 | 920 | GGTTAAAAGGCTATAT | eekd$_{10}$kke | 6 | 27169 | 27184 | 1577 |
| 547958 | 907 | 922 | CAGGTTAAAAGGCTAT | eekd$_{10}$kke | 57 | 27171 | 27186 | 1578 |
| 547959 | 908 | 923 | GCAGGTTAAAAGGCTA | eekd$_{10}$kke | 60 | 27172 | 27187 | 1579 |
| 547960 | 909 | 924 | TGCAGGTTAAAAGGCT | eekd$_{10}$kke | 40 | 27173 | 27188 | 1580 |
| 547961 | 910 | 925 | TTGCAGGTTAAAAGGC | eekd$_{10}$kke | 5 | 27174 | 27189 | 1581 |
| 547962 | 911 | 926 | TTTGCAGGTTAAAAGG | eekd$_{10}$kke | 16 | 27175 | 27190 | 1582 |
| 547963 | 927 | 942 | GTTCAGGTAAAGTTCT | eekd$_{10}$kke | 22 | n/a | n/a | 1583 |
| 547964 | 928 | 943 | GGTTCAGGTAAAGTTC | eekd$_{10}$kke | 0 | n/a | n/a | 1584 |

TABLE 23-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 547965 | 929 | 944 | GGGTTCAGGTAAAGTT | eekd$_{10}$kke | 29 | n/a | n/a | 1585 |
| 547966 | 930 | 945 | AGGGTTCAGGTAAAGT | eekd$_{10}$kke | 13 | n/a | n/a | 1586 |
| 547967 | 933 | 948 | GGCAGGGTTCAGGTAA | eekd$_{10}$kke | 25 | n/a | n/a | 1587 |
| 547968 | 940 | 955 | TTAGAATGGCAGGGTT | eekd$_{10}$kke | 37 | 27362 | 27377 | 1588 |
| 547969 | 953 | 968 | TCCCGGGTAAATTTTA | eekd$_{10}$kke | 0 | 27375 | 27390 | 1589 |
| 547970 | 954 | 969 | CTCCCGGGTAAATTTT | eekd$_{10}$kke | 42 | 27376 | 27391 | 1590 |
| 547972 | 958 | 973 | TCAACTCCCGGGTAAA | eekd$_{10}$kke | 49 | 27380 | 27395 | 1591 |
| 547973 | 961 | 976 | AAGTCAACTCCCGGGT | eekd$_{10}$kke | 62 | 27383 | 27398 | 1592 |
| 547974 | 962 | 977 | AAAGTCAACTCCCGGG | eekd$_{10}$kke | 52 | 27384 | 27399 | 1593 |
| 547975 | 963 | 978 | CAAAGTCAACTCCCGG | eekd$_{10}$kke | 44 | 27385 | 27400 | 1594 |
| 547976 | 964 | 979 | CCAAAGTCAACTCCCG | eekd$_{10}$kke | 49 | 27386 | 27401 | 1595 |
| 547977 | 967 | 982 | CCTCCAAAGTCAACTC | eekd$_{10}$kke | 57 | 27389 | 27404 | 1596 |
| 547978 | 1014 | 1029 | CTTGGCAAACATTCAC | eekd$_{10}$kke | 71 | 27436 | 27451 | 1597 |
| 547979 | 1018 | 1033 | GTCTCTTGGCAAACAT | eekd$_{10}$kke | 77 | 27440 | 27455 | 1598 |
| 547980 | 1020 | 1035 | AAGTCTCTTGGCAAAC | eekd$_{10}$kke | 54 | 27442 | 27457 | 1599 |
| 547981 | 1029 | 1044 | TCTTTGTGCAAGTCTC | eekd$_{10}$kke | 76 | 27451 | 27466 | 1600 |
| 547982 | 1034 | 1049 | AATCATCTTTGTGCAA | eekd$_{10}$kke | 54 | 27456 | 27471 | 1601 |
| 547983 | 1035 | 1050 | GAATCATCTTTGTGCA | eekd$_{10}$kke | 56 | 27457 | 27472 | 1602 |
| 547984 | 1036 | 1051 | CGAATCATCTTTGTGC | eekd$_{10}$kke | 55 | 27458 | 27473 | 1603 |
| 547985 | 1037 | 1052 | GCGAATCATCTTTGTG | eekd$_{10}$kke | 63 | 27459 | 27474 | 1604 |
| 547986 | 1039 | 1054 | CAGCGAATCATCTTTG | eekd$_{10}$kke | 63 | 27461 | 27476 | 1605 |
| 547987 | 1040 | 1055 | ACAGCGAATCATCTTT | eekd$_{10}$kke | 64 | 27462 | 27477 | 1606 |
| 547988 | 1042 | 1057 | TGACAGCGAATCATCT | eekd$_{10}$kke | 56 | 27464 | 27479 | 1607 |
| 547989 | 1043 | 1058 | CTGACAGCGAATCATC | eekd$_{10}$kke | 66 | 27465 | 27480 | 1608 |
| 547990 | 1044 | 1059 | ACTGACAGCGAATCAT | eekd$_{10}$kke | 58 | 27466 | 27481 | 1609 |
| 547991 | 1077 | 1092 | TACAGTCTTCTGGGAG | eekd$_{10}$kke | 0 | 27499 | 27514 | 1610 |
| 547992 | 1080 | 1095 | CCTTACAGTCTTCTGG | eekd$_{10}$kke | 17 | 27502 | 27517 | 1611 |
| 547993 | 1113 | 1128 | TAGATAATCTTAAGAA | eekd$_{10}$kke | 26 | 27634 | 27649 | 1612 |
| 547994 | 1120 | 1135 | CCATCCATAGATAATC | eekd$_{10}$kke | 53 | 27641 | 27656 | 1613 |
| 547995 | 1149 | 1164 | GTGTCCCATACGCAAT | eekd$_{10}$kke | 64 | 27670 | 27685 | 1614 |
| 547996 | 1150 | 1165 | TGTGTCCCATACGCAA | eekd$_{10}$kke | 65 | 27671 | 27686 | 1615 |

TABLE 24

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 531231 | n/a | n/a | TATCACTGTACTAGTTTCCT | eeeeed$_{10}$eeeee | 0 | 14744 | 14763 | 334 |
|  |  |  |  |  |  | 14815 | 14834 |  |
|  |  |  |  |  |  | 14886 | 14905 |  |
|  |  |  |  |  |  | 14945 | 14964 |  |
|  |  |  |  |  |  | 15005 | 15024 |  |
|  |  |  |  |  |  | 15077 | 15096 |  |
|  |  |  |  |  |  | 15220 | 15239 |  |
|  |  |  |  |  |  | 15292 | 15311 |  |
|  |  |  |  |  |  | 15351 | 15370 |  |
|  |  |  |  |  |  | 15411 | 15430 |  |
|  |  |  |  |  |  | 15483 | 15502 |  |
|  |  |  |  |  |  | 15555 | 15574 |  |
|  |  |  |  |  |  | 15613 | 15632 |  |
|  |  |  |  |  |  | 15685 | 15704 |  |
|  |  |  |  |  |  | 15815 | 15834 |  |
|  |  |  |  |  |  | 15887 | 15906 |  |
|  |  |  |  |  |  | 15945 | 15964 |  |
| 547747 | n/a | n/a | TCACTGTACTAGTTTC | eekd$_{10}$kke | 80 | 14746 | 14761 | 1267 |
|  |  |  |  |  |  | 14817 | 14832 |  |
|  |  |  |  |  |  | 14888 | 14903 |  |
|  |  |  |  |  |  | 14947 | 14962 |  |
|  |  |  |  |  |  | 15007 | 15022 |  |
|  |  |  |  |  |  | 15079 | 15094 |  |
|  |  |  |  |  |  | 15222 | 15237 |  |
|  |  |  |  |  |  | 15294 | 15309 |  |
|  |  |  |  |  |  | 15353 | 15368 |  |
|  |  |  |  |  |  | 15413 | 15428 |  |
|  |  |  |  |  |  | 15485 | 15500 |  |
|  |  |  |  |  |  | 15557 | 15572 |  |
|  |  |  |  |  |  | 15615 | 15630 |  |
|  |  |  |  |  |  | 15687 | 15702 |  |
|  |  |  |  |  |  | 15817 | 15832 |  |
|  |  |  |  |  |  | 15889 | 15904 |  |
|  |  |  |  |  |  | 15947 | 15962 |  |
| 547997 | 1151 | 1166 | TTGTGTCCCATACGCA | eekd$_{10}$kke | 89 | 27672 | 27687 | 1616 |
| 547998 | 1152 | 1167 | CTTGTGTCCCATACGC | eekd$_{10}$kke | 82 | 27673 | 27688 | 1617 |
| 547999 | 1153 | 1168 | CCTTGTGTCCCATACG | eekd$_{10}$kke | 50 | 27674 | 27689 | 1618 |
| 548000 | 1154 | 1169 | CCCTTGTGTCCCATAC | eekd$_{10}$kke | 54 | 27675 | 27690 | 1619 |
| 548001 | 1163 | 1178 | ACCAGAGCTCCCTTGT | eekd$_{10}$kke | 64 | 27684 | 27699 | 1620 |
| 548002 | 1164 | 1179 | AACCAGAGCTCCCTTG | eekd$_{10}$kke | 56 | 27685 | 27700 | 1621 |
| 548003 | 1165 | 1180 | TAACCAGAGCTCCCTT | eekd$_{10}$kke | 66 | 27686 | 27701 | 1622 |
| 548004 | 1167 | 1182 | AGTAACCAGAGCTCCC | eekd$_{10}$kke | 80 | 27688 | 27703 | 1623 |
| 548005 | 1169 | 1184 | AGAGTAACCAGAGCTC | eekd$_{10}$kke | 77 | 27690 | 27705 | 1624 |
| 548006 | 1172 | 1187 | CAAAGAGTAACCAGAG | eekd$_{10}$kke | 54 | 27693 | 27708 | 1625 |
| 548007 | 1174 | 1189 | CTCAAAGAGTAACCAG | eekd$_{10}$kke | 70 | 27695 | 27710 | 1626 |
| 548008 | 1175 | 1190 | TCTCAAAGAGTAACCA | eekd$_{10}$kke | 71 | 27696 | 27711 | 1627 |
| 548009 | 1184 | 1199 | GTTACACAATCTCAAA | eekd$_{10}$kke | 47 | 27705 | 27720 | 1628 |
| 548010 | 1187 | 1202 | AGTGTTACACAATCTC | eekd$_{10}$kke | 80 | 27708 | 27723 | 1629 |
| 548011 | 1189 | 1204 | CCAGTGTTACACAATC | eekd$_{10}$kke | 14 | 27710 | 27725 | 1630 |
| 548012 | 1192 | 1207 | TCCCAGTGTTACACA | eekd$_{10}$kke | 3 | 27713 | 27728 | 1631 |
| 548013 | 1193 | 1208 | GTCCCAGTGTTACAC | eekd$_{10}$kke | 37 | 27714 | 27729 | 1632 |
| 548014 | 1194 | 1209 | TGTCCCAGTGTTACA | eekd$_{10}$kke | 31 | 27715 | 27730 | 1633 |
| 548015 | 1195 | 1210 | TTGTCCCAGTGTTAC | eekd$_{10}$kke | 50 | 27716 | 27731 | 1634 |

TABLE 24-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 548016 | 1248 | 1263 | AAGAGTTTGTTCCTCC | eekd$_{10}$kke | 55 | 27924 | 27939 | 1635 |
| 548017 | 1252 | 1267 | CAAGAAGAGTTTGTTC | eekd$_{10}$kke | 3 | 27928 | 27943 | 1636 |
| 548018 | 1253 | 1268 | CCAAGAAGAGTTTGTT | eekd$_{10}$kke | 22 | 27929 | 27944 | 1637 |
| 548019 | 1255 | 1270 | CCCCAAGAAGAGTTTG | eekd$_{10}$kke | 24 | 27931 | 27946 | 1638 |
| 548020 | 1256 | 1271 | TCCCCAAGAAGAGTTT | eekd$_{10}$kke | 76 | 27932 | 27947 | 1639 |
| 548021 | 1261 | 1276 | CACTCTCCCCAAGAAG | eekd$_{10}$kke | 0 | 27937 | 27952 | 1640 |
| 548022 | 1262 | 1277 | CCACTCTCCCCAAGAA | eekd$_{10}$kke | 69 | 27938 | 27953 | 1641 |
| 548023 | 1290 | 1305 | GCTTCACCTGCAGGCT | eekd$_{10}$kke | 58 | 27966 | 27981 | 1642 |
| 548024 | 1297 | 1312 | GCTGTCAGCTTCACCT | eekd$_{10}$kke | 79 | 27973 | 27988 | 1643 |
| 548025 | 1300 | 1315 | TGAGCTGTCAGCTTCA | eekd$_{10}$kke | 66 | 27976 | 27991 | 1644 |
| 548026 | 1332 | 1347 | GTCCTATGAGTGACCC | eekd$_{10}$kke | 52 | 28008 | 28023 | 1645 |
| 548027 | 1334 | 1349 | GTGTCCTATGAGTGAC | eekd$_{10}$kke | 18 | 28010 | 28025 | 1646 |
| 548028 | 1335 | 1350 | GGTGTCCTATGAGTGA | eekd$_{10}$kke | 38 | 28011 | 28026 | 1647 |
| 548029 | 1336 | 1351 | TGGTGTCCTATGAGTG | eekd$_{10}$kke | 12 | 28012 | 28027 | 1648 |
| 548030 | 1337 | 1352 | CTGGTGTCCTATGAGT | eekd$_{10}$kke | 52 | 28013 | 28028 | 1649 |
| 548031 | 1397 | 1412 | GATGCGCCAAACATCC | eekd$_{10}$kke | 73 | 30475 | 30490 | 1650 |
| 548032 | 1398 | 1413 | AGATGCGCCAAACATC | eekd$_{10}$kke | 51 | 30476 | 30491 | 1651 |
| 548034 | 1400 | 1415 | ATAGATGCGCCAAACA | eekd$_{10}$kke | 31 | 30478 | 30493 | 1652 |
| 548035 | 1404 | 1419 | CACTATAGATGCGCCA | eekd$_{10}$kke | 44 | 30482 | 30497 | 1653 |
| 548036 | 1405 | 1420 | CCACTATAGATGCGCC | eekd$_{10}$kke | 74 | 30483 | 30498 | 1654 |
| 548037 | 1427 | 1442 | AATGTCTGACAGATTT | eekd$_{10}$kke | 70 | 30505 | 30520 | 1655 |
| 548038 | 1428 | 1443 | TAATGTCTGACAGATT | eekd$_{10}$kke | 67 | 30506 | 30521 | 1656 |
| 548039 | 1445 | 1460 | GAAAGGTGTATCTTTT | eekd$_{10}$kke | 29 | 30523 | 30538 | 1657 |
| 548040 | 1449 | 1464 | GTGAGAAAGGTGTATC | eekd$_{10}$kke | 62 | 30527 | 30542 | 1658 |
| 548041 | 1450 | 1465 | TGTGAGAAAGGTGTAT | eekd$_{10}$kke | 64 | 30528 | 30543 | 1659 |
| 548042 | 1452 | 1467 | TTTGTGAGAAAGGTGT | eekd$_{10}$kke | 63 | 30530 | 30545 | 1660 |
| 548043 | 1453 | 1468 | ATTTGTGAGAAAGGTG | eekd$_{10}$kke | 76 | 30531 | 30546 | 1661 |
| 548044 | 1474 | 1489 | TGGTGAATAATAATCT | eekd$_{10}$kke | 12 | 30552 | 30567 | 1662 |
| 548045 | 1483 | 1498 | TTATAGTTTTGGTGAA | eekd$_{10}$kke | 0 | 30561 | 30576 | 1663 |
| 548046 | 1506 | 1521 | TATCATGATTCCCTTC | eekd$_{10}$kke | 84 | 30584 | 30599 | 1664 |
| 548047 | 1508 | 1523 | GATATCATGATTCCCT | eekd$_{10}$kke | 83 | 30586 | 30601 | 1665 |
| 548048 | 1509 | 1524 | CGATATCATGATTCCC | eekd$_{10}$kke | 84 | 30587 | 30602 | 1666 |
| 548049 | 1510 | 1525 | GCGATATCATGATTCC | eekd$_{10}$kke | 62 | 30588 | 30603 | 1667 |
| 548050 | 1512 | 1527 | AGGCGATATCATGATT | eekd$_{10}$kke | 37 | 30590 | 30605 | 1668 |
| 548051 | 1513 | 1528 | AAGGCGATATCATGAT | eekd$_{10}$kke | 61 | 30591 | 30606 | 1669 |
| 548052 | 1535 | 1550 | CAAAGGAGCCTGGAGT | eekd$_{10}$kke | 43 | 30613 | 30628 | 1670 |

TABLE 24-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 548053 | 1538 | 1553 | ATTCAAAGGAGCCTGG | eekd$_{10}$kke | 36 | 30616 | 30631 | 1671 |
| 548054 | 1539 | 1554 | AATTCAAAGGAGCCTG | eekd$_{10}$kke | 45 | 30617 | 30632 | 1672 |
| 548055 | 1541 | 1556 | GTAATTCAAAGGAGCC | eekd$_{10}$kke | 78 | 30619 | 30634 | 1673 |
| 548056 | 1543 | 1558 | GTGTAATTCAAAGGAG | eekd$_{10}$kke | 40 | 30621 | 30636 | 1674 |
| 548057 | 1564 | 1579 | CATATTGGTTTTGGA | eekd$_{10}$kke | 49 | 31870 | 31885 | 1675 |
| 548058 | 1565 | 1580 | GCATATTGGTTTTGG | eekd$_{10}$kke | 71 | 31871 | 31886 | 1676 |
| 548059 | 1568 | 1583 | TAGGCATATTGGTTTT | eekd$_{10}$kke | 50 | 31874 | 31889 | 1677 |
| 548060 | 1588 | 1603 | CTTGTGTCACCTTTGG | eekd$_{10}$kke | 76 | 31894 | 31909 | 1678 |
| 548061 | 1589 | 1604 | GCTTGTGTCACCTTTG | eekd$_{10}$kke | 86 | 31895 | 31910 | 1679 |
| 548062 | 1598 | 1613 | ATAAATTGTGCTTGTG | eekd$_{10}$kke | 19 | 31904 | 31919 | 1680 |
| 548063 | 1600 | 1615 | GTATAAATTGTGCTTG | eekd$_{10}$kke | 35 | 31906 | 31921 | 1681 |
| 548064 | 1602 | 1617 | TGGTATAAATTGTGCT | eekd$_{10}$kke | 54 | 31908 | 31923 | 1682 |
| 548065 | 1603 | 1618 | TTGGTATAAATTGTGC | eekd$_{10}$kke | 22 | 31909 | 31924 | 1683 |
| 548067 | 1606 | 1621 | CAGTTGGTATAAATTG | eekd$_{10}$kke | 18 | 31912 | 31927 | 1684 |
| 548068 | 1609 | 1624 | CAACAGTTGGTATAAA | eekd$_{10}$kke | 0 | 31915 | 31930 | 1685 |
| 548069 | 1610 | 1625 | CCAACAGTTGGTATAA | eekd$_{10}$kke | 57 | 31916 | 31931 | 1686 |
| 548070 | 1611 | 1626 | CCCAACAGTTGGTATA | eekd$_{10}$kke | 85 | 31917 | 31932 | 1687 |
| 548071 | 1629 | 1644 | AGAAGCCCCATCCGGT | eekd$_{10}$kke | 55 | 31935 | 31950 | 1688 |
| 548072 | 1640 | 1655 | TTTCTCCTTCGAGAAG | eekd$_{10}$kke | 33 | 31946 | 31961 | 1689 |
| 548073 | 1641 | 1656 | CTTTCTCCTTCGAGAA | eekd$_{10}$kke | 24 | 31947 | 31962 | 1690 |

TABLE 25

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 531231 | n/a | n/a | TATCACTGTACTAGTTTCCT | eeeeed$_{10}$eeeee | 19 | 14744 14815 14886 14945 15005 15077 15220 15292 15351 15411 15483 15555 15613 15685 15815 15887 15945 | 14763 14834 14905 14964 15024 15096 15239 15311 15370 15430 15502 15574 15632 15704 15834 15906 15964 | 334 |
| 547747 | n/a | n/a | TCACTGTACTAGTTTC | eekd$_{10}$kke | 66 | 14746 14817 14888 | 14761 14832 14903 | 1267 |

TABLE 25-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| | | | | | | 14947 | 14962 | |
| | | | | | | 15007 | 15022 | |
| | | | | | | 15079 | 15094 | |
| | | | | | | 15222 | 15237 | |
| | | | | | | 15294 | 15309 | |
| | | | | | | 15353 | 15368 | |
| | | | | | | 15413 | 15428 | |
| | | | | | | 15485 | 15500 | |
| | | | | | | 15557 | 15572 | |
| | | | | | | 15615 | 15630 | |
| | | | | | | 15687 | 15702 | |
| | | | | | | 15817 | 15832 | |
| | | | | | | 15889 | 15904 | |
| | | | | | | 15947 | 15962 | |
| 548151 | n/a | n/a | GGGCTTCAGCCAGACA | eekd$_{10}$kke | 35 | 34238 | 34253 | 1691 |
| 548152 | n/a | n/a | CGGGCTTCAGCCAGAC | eekd$_{10}$kke | 32 | 34239 | 34254 | 1692 |
| 548153 | 2148 | 2163 | TGCTGAAAGCGGGCTT | eekd$_{10}$kke | 44 | 34248 | 34263 | 1693 |
| 548154 | 2149 | 2164 | GTGCTGAAAGCGGGCT | eekd$_{10}$kke | 7 | 34249 | 34264 | 1694 |
| 548155 | 2150 | 2165 | CGTGCTGAAAGCGGGC | eekd$_{10}$kke | 76 | 34250 | 34265 | 1695 |
| 548156 | 2167 | 2182 | TCAGCCCCTGGTTACG | eekd$_{10}$kke | 0 | 34267 | 34282 | 1696 |
| 548157 | 2171 | 2186 | ATTGTCAGCCCCTGGT | eekd$_{10}$kke | 7 | 34271 | 34286 | 1697 |
| 548158 | 2173 | 2188 | GCATTGTCAGCCCCTG | eekd$_{10}$kke | 18 | 34273 | 34288 | 1698 |
| 548159 | 2174 | 2189 | CGCATTGTCAGCCCCT | eekd$_{10}$kke | 59 | 34274 | 34289 | 1699 |
| 548160 | 2175 | 2190 | TCGCATTGTCAGCCCC | eekd$_{10}$kke | 60 | 34275 | 34290 | 1700 |
| 548161 | 2176 | 2191 | CTCGCATTGTCAGCCC | eekd$_{10}$kke | 59 | 34276 | 34291 | 1701 |
| 548162 | 2177 | 2192 | CCTCGCATTGTCAGCC | eekd$_{10}$kke | 25 | 34277 | 34292 | 1702 |
| 548163 | 2178 | 2193 | ACCTCGCATTGTCAGC | eekd$_{10}$kke | 46 | 34278 | 34293 | 1703 |
| 548164 | 2179 | 2194 | GACCTCGCATTGTCAG | eekd$_{10}$kke | 40 | 34279 | 34294 | 1704 |
| 548165 | 2180 | 2195 | CGACCTCGCATTGTCA | eekd$_{10}$kke | 53 | 34280 | 34295 | 1705 |
| 548166 | 2181 | 2196 | GCGACCTCGCATTGTC | eekd$_{10}$kke | 0 | 34281 | 34296 | 1706 |
| 548167 | 2182 | 2197 | TGCGACCTCGCATTGT | eekd$_{10}$kke | 36 | 34282 | 34297 | 1707 |
| 548168 | 2183 | 2198 | TTGCGACCTCGCATTG | eekd$_{10}$kke | 61 | 34283 | 34298 | 1708 |
| 548169 | 2184 | 2199 | GTTGCGACCTCGCATT | eekd$_{10}$kke | 7 | 34284 | 34299 | 1709 |
| 548170 | 2185 | 2200 | AGTTGCGACCTCGCAT | eekd$_{10}$kke | 68 | 34285 | 34300 | 1710 |
| 548171 | 2186 | 2201 | CAGTTGCGACCTCGCA | eekd$_{10}$kke | 47 | 34286 | 34301 | 1711 |
| 548172 | 2187 | 2202 | TCAGTTGCGACCTCGC | eekd$_{10}$kke | 0 | 34287 | 34302 | 1712 |
| 548173 | 2188 | 2203 | CTCAGTTGCGACCTCG | eekd$_{10}$kke | 51 | 34288 | 34303 | 1713 |
| 548174 | 2189 | 2204 | TCTCAGTTGCGACCTC | eekd$_{10}$kke | 68 | 34289 | 34304 | 1714 |
| 548175 | 2190 | 2205 | ATCTCAGTTGCGACCT | eekd$_{10}$kke | 0 | 34290 | 34305 | 1715 |
| 548176 | 2191 | 2206 | GATCTCAGTTGCGACC | eekd$_{10}$kke | 38 | 34291 | 34306 | 1716 |
| 548177 | 2192 | 2207 | AGATCTCAGTTGCGAC | eekd$_{10}$kke | 45 | 34292 | 34307 | 1717 |
| 548178 | 2193 | 2208 | GAGATCTCAGTTGCGA | eekd$_{10}$kke | 54 | 34293 | 34308 | 1718 |
| 548179 | 2194 | 2209 | GGAGATCTCAGTTGCG | eekd$_{10}$kke | 52 | 34294 | 34309 | 1719 |

TABLE 25-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 548180 | 2198 | 2213 | TCATGGAGATCTCAGT | eekd$_{10}$kke | 79 | 34298 | 34313 | 1720 |
| 548181 | 2199 | 2214 | GTCATGGAGATCTCAG | eekd$_{10}$kke | 55 | 34299 | 34314 | 1721 |
| 548182 | 2200 | 2215 | AGTCATGGAGATCTCA | eekd$_{10}$kke | 55 | 34300 | 34315 | 1722 |
| 548183 | 2201 | 2216 | CAGTCATGGAGATCTC | eekd$_{10}$kke | 43 | 34301 | 34316 | 1723 |
| 548184 | 2202 | 2217 | ACAGTCATGGAGATCT | eekd$_{10}$kke | 73 | 34302 | 34317 | 1724 |
| 548185 | 2207 | 2222 | AACACACAGTCATGGA | eekd$_{10}$kke | 23 | 34307 | 34322 | 1725 |
| 548186 | 2208 | 2223 | CAACACACAGTCATGG | eekd$_{10}$kke | 0 | 34308 | 34323 | 1726 |
| 548187 | n/a | n/a | CATCCTATCCGTGTTC | eekd$_{10}$kke | 33 | 3279 | 3294 | 1727 |
| 548189 | n/a | n/a | CATGAACATCCTATCC | eekd$_{10}$kke | 24 | 3285 | 3300 | 1728 |
| 548190 | n/a | n/a | TATTCCATGAACATCC | eekd$_{10}$kke | 43 | 3290 | 3305 | 1729 |
| 548191 | n/a | n/a | GTCAACATATTCCATG | eekd$_{10}$kke | 0 | 3297 | 3312 | 1730 |
| 548192 | n/a | n/a | CCTGTCAACATATTCC | eekd$_{10}$kke | 65 | 3300 | 3315 | 1731 |
| 548193 | n/a | n/a | TGTCCTGTCAACATAT | eekd$_{10}$kke | 58 | 3303 | 3318 | 1732 |
| 548194 | n/a | n/a | GCCAACAGTTTCAACT | eekd$_{10}$kke | 61 | 3322 | 3337 | 1733 |
| 548195 | n/a | n/a | TTCTGCCAACAGTTTC | eekd$_{10}$kke | 84 | 3326 | 3341 | 1734 |
| 548196 | n/a | n/a | CAATATTGACTTTGGG | eekd$_{10}$kke | 6 | 3343 | 3358 | 1735 |
| 548197 | n/a | n/a | TGCTTGGCTTCAATAT | eekd$_{10}$kke | 68 | 3353 | 3368 | 1736 |
| 548198 | n/a | n/a | ACTGCAGGCAATATTT | eekd$_{10}$kke | 49 | 3369 | 3384 | 1737 |
| 548199 | n/a | n/a | GCACTGCAGGCAATAT | eekd$_{10}$kke | 24 | 3371 | 3386 | 1738 |
| 548200 | n/a | n/a | CTAATGTGGCACTGCA | eekd$_{10}$kke | 19 | 3379 | 3394 | 1739 |
| 548201 | n/a | n/a | TGTTCTAATGTGGCAC | eekd$_{10}$kke | 67 | 3383 | 3398 | 1740 |
| 548202 | n/a | n/a | GCTGTTCTAATGTGGC | eekd$_{10}$kke | 9 | 3385 | 3400 | 1741 |
| 548203 | n/a | n/a | TGACTAGTGAATGGCT | eekd$_{10}$kke | 73 | 2280 | 2295 | 1742 |
| 548204 | n/a | n/a | TCTGACTAGTGAATGG | eekd$_{10}$kke | 25 | 2282 | 2297 | 1743 |
| 548205 | n/a | n/a | TCAATCTGACTAGTGA | eekd$_{10}$kke | 14 | 2286 | 2301 | 1744 |
| 548206 | n/a | n/a | GGTCAATCTGACTAGT | eekd$_{10}$kke | 45 | 2288 | 2303 | 1745 |
| 548207 | n/a | n/a | CTGGTCAATCTGACTA | eekd$_{10}$kke | 60 | 2290 | 2305 | 1746 |
| 548208 | n/a | n/a | CTCTGGTCAATCTGAC | eekd$_{10}$kke | 19 | 2292 | 2307 | 1747 |
| 548209 | n/a | n/a | CAATCTCTGGTCAATC | eekd$_{10}$kke | 57 | 2296 | 2311 | 1748 |
| 548210 | n/a | n/a | CAACAATCTCTGGTCA | eekd$_{10}$kke | 55 | 2299 | 2314 | 1749 |
| 548211 | n/a | n/a | ACCAACAATCTCTGGT | eekd$_{10}$kke | 51 | 2301 | 2316 | 1750 |
| 548212 | n/a | n/a | AGCCCACCAACAATCT | eekd$_{10}$kke | 44 | 2306 | 2321 | 1751 |
| 548213 | n/a | n/a | GACAGCCCACCAACAA | eekd$_{10}$kke | 70 | 2309 | 2324 | 1752 |
| 548214 | n/a | n/a | CAGACAGCCCACCAAC | eekd$_{10}$kke | 55 | 2311 | 2326 | 1753 |
| 548215 | n/a | n/a | GCATAGACCCCAACAG | eekd$_{10}$kke | 61 | 2324 | 2339 | 1754 |
| 548216 | n/a | n/a | GTGCATAGACCCCAAC | eekd$_{10}$kke | 45 | 2326 | 2341 | 1755 |
| 548217 | n/a | n/a | CTGTGCATAGACCCCA | eekd$_{10}$kke | 69 | 2328 | 2343 | 1756 |

TABLE 25-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 548218 | n/a | n/a | TCCTGTGCATAGACCC | eekd$_{10}$kke | 59 | 2330 | 2345 | 1757 |
| 548219 | n/a | n/a | GAAATCCTGTGCATAG | eekd$_{10}$kke | 8 | 2334 | 2349 | 1758 |
| 548220 | n/a | n/a | GCAGAAATCCTGTGCA | eekd$_{10}$kke | 69 | 2337 | 2352 | 1759 |
| 548221 | n/a | n/a | ACTCCAGCAGAAATCC | eekd$_{10}$kke | 49 | 2343 | 2358 | 1760 |
| 548222 | n/a | n/a | AATCATGCCTTGTGGG | eekd$_{10}$kke | 32 | 4765 | 4780 | 1761 |
| 548223 | n/a | n/a | TAGACCCAGAATCATG | eekd$_{10}$kke | 50 | 4774 | 4789 | 1762 |
| 548224 | n/a | n/a | CCATAGACCCAGAATC | eekd$_{10}$kke | 20 | 4777 | 4792 | 1763 |
| 548225 | n/a | n/a | AGTCACCATAGACCCA | eekd$_{10}$kke | 48 | 4782 | 4797 | 1764 |
| 548226 | n/a | n/a | TAAGTCACCATAGACC | eekd$_{10}$kke | 39 | 4784 | 4799 | 1765 |
| 548227 | n/a | n/a | GTGGCCCTCTTAAGTC | eekd$_{10}$kke | 0 | 4794 | 4809 | 1766 |

TABLE 26

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 531231 | n/a | n/a | TATCACTGTACTAGTTTCCT | eeeeed$_{10}$eeeee | 42 | 14744 | 14763 | 334 |
|  |  |  |  |  |  | 14815 | 14834 |  |
|  |  |  |  |  |  | 14886 | 14905 |  |
|  |  |  |  |  |  | 14945 | 14964 |  |
|  |  |  |  |  |  | 15005 | 15024 |  |
|  |  |  |  |  |  | 15077 | 15096 |  |
|  |  |  |  |  |  | 15220 | 15239 |  |
|  |  |  |  |  |  | 15292 | 15311 |  |
|  |  |  |  |  |  | 15351 | 15370 |  |
|  |  |  |  |  |  | 15411 | 15430 |  |
|  |  |  |  |  |  | 15483 | 15502 |  |
|  |  |  |  |  |  | 15555 | 15574 |  |
|  |  |  |  |  |  | 15613 | 15632 |  |
|  |  |  |  |  |  | 15685 | 15704 |  |
|  |  |  |  |  |  | 15815 | 15834 |  |
|  |  |  |  |  |  | 15887 | 15906 |  |
|  |  |  |  |  |  | 15945 | 15964 |  |
| 547747 | n/a | n/a | TCACTGTACTAGTTTC | eekd$_{10}$kke | 80 | 14746 | 14761 | 1267 |
|  |  |  |  |  |  | 14817 | 14832 |  |
|  |  |  |  |  |  | 14888 | 14903 |  |
|  |  |  |  |  |  | 14947 | 14962 |  |
|  |  |  |  |  |  | 15007 | 15022 |  |
|  |  |  |  |  |  | 15079 | 15094 |  |
|  |  |  |  |  |  | 15222 | 15237 |  |
|  |  |  |  |  |  | 15294 | 15309 |  |
|  |  |  |  |  |  | 15353 | 15368 |  |
|  |  |  |  |  |  | 15413 | 15428 |  |
|  |  |  |  |  |  | 15485 | 15500 |  |
|  |  |  |  |  |  | 15557 | 15572 |  |
|  |  |  |  |  |  | 15615 | 15630 |  |
|  |  |  |  |  |  | 15687 | 15702 |  |
|  |  |  |  |  |  | 15817 | 15832 |  |
|  |  |  |  |  |  | 15889 | 15904 |  |
|  |  |  |  |  |  | 15947 | 15962 |  |
| 548228 | n/a | n/a | GTTGTGTGGCCCTCTT | eekd$_{10}$kke | 37 | 4799 | 4814 | 1767 |
| 548229 | n/a | n/a | CATTGTTGTGTGGCCC | eekd$_{10}$kke | 31 | 4803 | 4818 | 1768 |

TABLE 26-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 548230 | n/a | n/a | TACTCATTGTTGTGTG | eekd$_{10}$kke | 10 | 4807 | 4822 | 1769 |
| 548231 | n/a | n/a | AATACTCATTGTTGTG | eekd$_{10}$kke | 11 | 4809 | 4824 | 1770 |
| 548232 | n/a | n/a | GCCATACATCTGAGGA | eekd$_{10}$kke | 3 | 4831 | 4846 | 1771 |
| 548233 | n/a | n/a | ATTGTAGCCATACATC | eekd$_{10}$kke | 38 | 4837 | 4852 | 1772 |
| 548234 | n/a | n/a | TTATTGTAGCCATACA | eekd$_{10}$kke | 17 | 4839 | 4854 | 1773 |
| 548235 | n/a | n/a | TCTAGATGACCTGAAG | eekd$_{10}$kke | 0 | 18147 | 18162 | 1774 |
| 548236 | n/a | n/a | TACATCTAGATGACCT | eekd$_{10}$kke | 37 | 18151 | 18166 | 1775 |
| 548237 | n/a | n/a | GTATACATCTAGATGA | eekd$_{10}$kke | 22 | 18154 | 18169 | 1776 |
| 548238 | n/a | n/a | ACTCGCCTTTGTGACT | eekd$_{10}$kke | 31 | 26268 | 26283 | 1777 |
| 548239 | n/a | n/a | TACTCGCCTTTGTGAC | eekd$_{10}$kke | 18 | 26269 | 26284 | 1778 |
| 548240 | n/a | n/a | ATACTCGCCTTTGTGA | eekd$_{10}$kke | 3 | 26270 26301 | 26285 26316 | 1779 |
| 548241 | n/a | n/a | CATACTCGCCTTTGTG | eekd$_{10}$kke | 1 | 26271 26302 | 26286 26317 | 1780 |
| 548242 | n/a | n/a | GCATACTCGCCTTTGT | eekd$_{10}$kke | 25 | 26272 26303 | 26287 26318 | 1781 |
| 548243 | n/a | n/a | ATGCATACTCGCCTTT | eekd$_{10}$kke | 0 | 26274 26305 | 26289 26320 | 1782 |
| 548244 | n/a | n/a | CATGCATACTCGCCTT | eekd$_{10}$kke | 51 | 26275 26306 | 26290 26321 | 1783 |
| 548245 | n/a | n/a | CCATGCATACTCGCCT | eekd$_{10}$kke | 31 | 26276 26307 | 26291 26322 | 1784 |
| 548246 | n/a | n/a | TTCCATGCATACTCGC | eekd$_{10}$kke | 46 | 26278 | 26293 | 1785 |
| 548247 | n/a | n/a | CGATTTTCCATGCATA | eekd$_{10}$kke | 56 | 26283 | 26298 | 1786 |
| 548248 | n/a | n/a | TGCGATTTTCCATGCA | eekd$_{10}$kke | 13 | 26285 | 26300 | 1787 |
| 548249 | n/a | n/a | TGTGATGCGATTTTCC | eekd$_{10}$kke | 22 | 26290 | 26305 | 1788 |
| 548250 | n/a | n/a | CTTTGTGATGCGATTT | eekd$_{10}$kke | 0 | 26293 | 26308 | 1789 |
| 548251 | n/a | n/a | GCCTTTGTGATGCGAT | eekd$_{10}$kke | 13 | 26295 | 26310 | 1790 |
| 548252 | n/a | n/a | ACTCGCCTTTGTGATG | eekd$_{10}$kke | 33 | 26299 | 26314 | 1791 |
| 548253 | n/a | n/a | TACTCGCCTTTGTGAT | eekd$_{10}$kke | 8 | 26300 | 26315 | 1792 |
| 548254 | n/a | n/a | CCCATGCATACTCGCC | eekd$_{10}$kke | 39 | 26308 | 26323 | 1793 |
| 548255 | n/a | n/a | CCCCATGCATACTCGC | eekd$_{10}$kke | 38 | 26309 | 26324 | 1794 |
| 548256 | n/a | n/a | GCTCCCCATGCATACT | eekd$_{10}$kke | 25 | 26312 | 26327 | 1795 |
| 548257 | n/a | n/a | AGTGCTCCCCATGCAT | eekd$_{10}$kke | 2 | 26315 | 26330 | 1796 |
| 548258 | n/a | n/a | CAAGTGCTCCCCATGC | eekd$_{10}$kke | 0 | 26317 | 26332 | 1797 |
| 548259 | n/a | n/a | GTGATGAAAGTACAGC | eekd$_{10}$kke | 45 | 26335 | 26350 | 1798 |
| 548260 | n/a | n/a | AGGAGTTTGTCAGAAC | eekd$_{10}$kke | 28 | 3210 | 3225 | 1799 |
| 548261 | n/a | n/a | TTCAGGGAGTGATGTC | eekd$_{10}$kke | 36 | 3241 | 3256 | 1800 |
| 548262 | n/a | n/a | CCTATCCGTGTTCAGC | eekd$_{10}$kke | 73 | 3276 | 3291 | 1801 |
| 548263 | n/a | n/a | CTCTACATACTCAGGA | eekd$_{10}$kke | 62 | 3561 | 3576 | 1802 |

TABLE 26-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 548264 | n/a | n/a | CAGTCCAAAAATCCCT | eekd$_{10}$kke | 60 | 3701 | 3716 | 1803 |
| 548265 | n/a | n/a | CCTCTTGATTTGGGCA | eekd$_{10}$kke | 85 | 3749 | 3764 | 1804 |
| 548266 | n/a | n/a | TTGGCCAACTCTGTGG | eekd$_{10}$kke | 44 | 3816 | 3831 | 1805 |
| 548267 | n/a | n/a | GACCTCCAGACTACTG | eekd$_{10}$kke | 34 | 3848 | 3863 | 1806 |
| 548268 | n/a | n/a | TGTGTCTAGGGAGTTG | eekd$_{10}$kke | 52 | 3898 | 3913 | 1807 |
| 548269 | n/a | n/a | AGCACACAATTACTGG | eekd$_{10}$kke | 62 | 3946 | 3961 | 1808 |
| 548270 | n/a | n/a | CTGCTGGTTTTAGACC | eekd$_{10}$kke | 28 | 4029 | 4044 | 1809 |
| 548271 | n/a | n/a | TTCACTTACCACAGGA | eekd$_{10}$kke | 56 | 4122 | 4137 | 1810 |
| 548272 | n/a | n/a | GGTGCCACTTGCTTGG | eekd$_{10}$kke | 54 | 4178 | 4193 | 1811 |
| 548273 | n/a | n/a | AATCTCCACCCCCGAA | eekd$_{10}$kke | 5 | 4224 | 4239 | 1812 |
| 548274 | n/a | n/a | TACCTGACAAGTGGTC | eekd$_{10}$kke | 0 | 4287 | 4302 | 1813 |
| 548275 | n/a | n/a | GTCCCAAGACATTCCT | eekd$_{10}$kke | 40 | 4350 | 4365 | 1814 |
| 548276 | n/a | n/a | CAGAGTGTCATCTGCG | eekd$_{10}$kke | 49 | 4389 | 4404 | 1815 |
| 548277 | n/a | n/a | GGATTGGACCCAGACA | eekd$_{10}$kke | 57 | 4511 | 4526 | 1816 |
| 548278 | n/a | n/a | GGTTCCCTAGCGGTCC | eekd$_{10}$kke | 74 | 4564 | 4579 | 1817 |
| 548279 | n/a | n/a | CACCTAGAACTATCCA | eekd$_{10}$kke | 39 | 4632 | 4647 | 1818 |
| 548280 | n/a | n/a | CTCCCTCTGTAATGAT | eekd$_{10}$kke | 43 | 4736 | 4751 | 1819 |
| 548281 | n/a | n/a | GGTTGAGGGACAGACA | eekd$_{10}$kke | 0 | 4944 | 4959 | 1820 |
| 548282 | n/a | n/a | GTGGGTTTGCACATGG | eekd$_{10}$kke | 73 | 4992 | 5007 | 1821 |
| 548283 | n/a | n/a | GGCTTATGCTCCTTCT | eekd$_{10}$kke | 56 | 5017 | 5032 | 1822 |
| 548284 | n/a | n/a | CCCCCTGTAGTTGGCT | eekd$_{10}$kke | 35 | 5051 | 5066 | 1823 |
| 548285 | n/a | n/a | GCTTACTTACATCCCT | eekd$_{10}$kke | 52 | 5132 | 5147 | 1824 |
| 548286 | n/a | n/a | GGGACTACATGCAATA | eekd$_{10}$kke | 47 | 5166 | 5181 | 1825 |
| 548287 | n/a | n/a | GTCAAAGAGTGTCCAC | eekd$_{10}$kke | 38 | 5283 | 5298 | 1826 |
| 548288 | n/a | n/a | GAATAGCAAGCTCCAA | eekd$_{10}$kke | 64 | 5348 | 5363 | 1827 |
| 548289 | n/a | n/a | CATGATACCACACCAC | eekd$_{10}$kke | 28 | 5484 | 5499 | 1828 |
| 548290 | n/a | n/a | GAGCACTCTTATTAGC | eekd$_{10}$kke | 31 | 5546 | 5561 | 1829 |
| 548291 | n/a | n/a | CCTGTTAGAGTTGGCC | eekd$_{10}$kke | 35 | 5576 | 5591 | 1830 |
| 548292 | n/a | n/a | AGGACACTGTTTCCAG | eekd$_{10}$kke | 38 | 5627 | 5642 | 1831 |
| 548293 | n/a | n/a | GTCACCAGAACCACAT | eekd$_{10}$kke | 44 | 5683 | 5698 | 1832 |
| 548294 | n/a | n/a | GTGTGCACTTTCTGGT | eekd$_{10}$kke | 33 | 5716 | 5731 | 1833 |
| 548295 | n/a | n/a | CTCTGATTGGGTCACC | eekd$_{10}$kke | 26 | 5746 | 5761 | 1834 |
| 548296 | n/a | n/a | ACCAACAACTCAGGCC | eekd$_{10}$kke | 34 | 5858 | 5873 | 1835 |
| 548297 | n/a | n/a | ACTCTCAAGCTCCACG | eekd$_{10}$kke | 32 | 5889 | 5904 | 1836 |
| 548298 | n/a | n/a | GGACAATATGTCTCCT | eekd$_{10}$kke | 0 | 5935 | 5950 | 1837 |
| 548299 | n/a | n/a | CATTGTGCTCAACTGA | eekd$_{10}$kke | 35 | 5961 | 5976 | 1838 |

TABLE 26-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 548300 | n/a | n/a | GCCCATGGTGAATCTG | eekd$_{10}$kke | 53 | 5995 | 6010 | 1839 |
| 548301 | n/a | n/a | CCTAGTACAAAGTGGC | eekd$_{10}$kke | 65 | 6050 | 6065 | 1840 |
| 548302 | n/a | n/a | GCCATTTTATCCCTGA | eekd$_{10}$kke | 71 | 6134 | 6149 | 1841 |
| 548303 | n/a | n/a | GGGCCCCCATGTCCAT | eekd$_{10}$kke | 0 | 6336 | 6351 | 1842 |

TABLE 27

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 531231 | n/a | n/a | TATCACTGTACTAGTTTCCT | eeeeed$_{10}$eeeee | 72 | 14744 14815 14886 14945 15005 15077 15220 15292 15351 15411 15483 15555 15613 15685 15815 15887 15945 | 14763 14834 14905 14964 15024 15096 15239 15311 15370 15430 15502 15574 15632 15704 15834 15906 15964 | 334 |
| 547747 | n/a | n/a | TCACTGTACTAGTTTC | eekd$_{10}$kke | 67 | 14746 14817 14888 14947 15007 15079 15222 15294 15353 15413 15485 15557 15615 15687 15817 15889 15947 | 14761 14832 14903 14962 15022 15094 15237 15309 15368 15428 15500 15572 15630 15702 15832 15904 15962 | 1267 |
| 548305 | n/a | n/a | GTTCTTGCTTATCCTC | eekd$_{10}$kke | 55 | 6484 | 6499 | 1843 |
| 548306 | n/a | n/a | ATGTGACAGTCAGGGA | eekd$_{10}$kke | 8 | 6559 | 6574 | 1844 |
| 548307 | n/a | n/a | TTCTGCAACTGAGCCT | eekd$_{10}$kke | 6 | 6587 | 6602 | 1845 |
| 548308 | n/a | n/a | AATGGCAGGTCCTGGC | eekd$_{10}$kke | 9 | 6616 | 6631 | 1846 |
| 548309 | n/a | n/a | AGACAGTTGGTGGTTT | eekd$_{10}$kke | 41 | 6700 | 6715 | 1847 |
| 548310 | n/a | n/a | GAGGAGTTGGTTTAGT | eekd$_{10}$kke | 0 | 6750 | 6765 | 1848 |
| 548311 | n/a | n/a | TGACCACCTCTCGGGT | eekd$_{10}$kke | 10 | 6860 | 6875 | 1849 |
| 548312 | n/a | n/a | ATTTGGCCCTGAGCCC | eekd$_{10}$kke | 0 | 6935 | 6950 | 1850 |
| 548313 | n/a | n/a | GCCTTTGAGGGAGTGG | eekd$_{10}$kke | 35 | 7024 | 7039 | 1851 |

TABLE 27-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 548314 | n/a | n/a | ACAACCTGTCCATTCC | eekd$_{10}$kke | 43 | 7087 | 7102 | 1852 |
| 548315 | n/a | n/a | GTTGTCAACTGGGACC | eekd$_{10}$kke | 14 | 7125 | 7140 | 1853 |
| 548316 | n/a | n/a | CTGTTCAGGTAGCACA | eekd$_{10}$kke | 64 | 7150 | 7165 | 1854 |
| 548317 | n/a | n/a | CCGGGAAAGACTGTCT | eekd$_{10}$kke | 42 | 7190 | 7205 | 1855 |
| 548318 | n/a | n/a | ACTGCACCCCACATAT | eekd$_{10}$kke | 18 | 7257 | 7272 | 1856 |
| 548319 | n/a | n/a | CCTCATCTCAGTATGA | eekd$_{10}$kke | 26 | 7398 | 7413 | 1857 |
| 548320 | n/a | n/a | GCACACAGACTTGCCC | eekd$_{10}$kke | 0 | 7508 | 7523 | 1858 |
| 548321 | n/a | n/a | CTGCATCTGGACTATG | eekd$_{10}$kke | 38 | 7559 | 7574 | 1859 |
| 548322 | n/a | n/a | AGGGAAATTAGAGGCA | eekd$_{10}$kke | 38 | 7586 | 7601 | 1860 |
| 548323 | n/a | n/a | CTGTTGCCTGACATGC | eekd$_{10}$kke | 43 | 7696 | 7711 | 1861 |
| 548324 | n/a | n/a | ACATAAATTCCCCACA | eekd$_{10}$kke | 29 | 7741 | 7756 | 1862 |
| 548325 | n/a | n/a | CCCACTGACTGACTAC | eekd$_{10}$kke | 27 | 7906 | 7921 | 1863 |
| 548326 | n/a | n/a | TCCTGTGACAGAACCA | eekd$_{10}$kke | 27 | 7988 | 8003 | 1864 |
| 548327 | n/a | n/a | CTACACCTTTCTGCAC | eekd$_{10}$kke | 6 | 8221 | 8236 | 1865 |
| 548328 | n/a | n/a | GGTCCTTGAACCCCGT | eekd$_{10}$kke | 68 | 8260 | 8275 | 1866 |
| 548329 | n/a | n/a | AGCAGATCTGGGTTGT | eekd$_{10}$kke | 59 | 8328 | 8343 | 1867 |
| 548330 | n/a | n/a | GACTAGCTTCTACTAC | eekd$_{10}$kke | 34 | 8404 | 8419 | 1868 |
| 548331 | n/a | n/a | ACAATCCCTTAGCCCA | eekd$_{10}$kke | 73 | 8457 | 8472 | 1869 |
| 548332 | n/a | n/a | GATGAAATGTGCACCT | eekd$_{10}$kke | 46 | 8491 | 8506 | 1870 |
| 548333 | n/a | n/a | GACTGTGCTATCCGCT | eekd$_{10}$kke | 58 | 8550 | 8565 | 1871 |
| 548334 | n/a | n/a | GCTCACTATAGGCCCC | eekd$_{10}$kke | 69 | 8656 | 8671 | 1872 |
| 548335 | n/a | n/a | TAGCATCATGCCACAG | eekd$_{10}$kke | 51 | 8684 | 8699 | 1873 |
| 548336 | n/a | n/a | GCACATTAGGAGGTAG | eekd$_{10}$kke | 1 | 9039 | 9054 | 1874 |
| 548337 | n/a | n/a | TACCGCTGGGTGCGGT | eekd$_{10}$kke | 10 | 9075 | 9090 | 1875 |
| 548338 | n/a | n/a | ATGAAACTGTGGCTCG | eekd$_{10}$kke | 80 | 9131 | 9146 | 1876 |
| 548339 | n/a | n/a | ACATGTGGGATCAGAG | eekd$_{10}$kke | 37 | 9275 | 9290 | 1877 |
| 548340 | n/a | n/a | GATGATCCTCACATAC | eekd$_{10}$kke | 35 | 9316 | 9331 | 1878 |
| 548341 | n/a | n/a | TAGAACCTTCCTCCAC | eekd$_{10}$kke | 30 | 9341 | 9356 | 1879 |
| 548342 | n/a | n/a | GGAAGACTTCCCTCTG | eekd$_{10}$kke | 0 | 9403 | 9418 | 1880 |
| 548343 | n/a | n/a | TAGTGATAAGAGCTGG | eekd$_{10}$kke | 78 | 9472 | 9487 | 1881 |
| 548344 | n/a | n/a | GGCAACTATGTTCTCA | eekd$_{10}$kke | 76 | 9536 | 9551 | 1882 |
| 548345 | n/a | n/a | CTAACTCCATCACTGC | eekd$_{10}$kke | 55 | 9637 | 9652 | 1883 |
| 548346 | n/a | n/a | TCCCCAATACTTGCTG | eekd$_{10}$kke | 35 | 9696 | 9711 | 1884 |
| 548347 | n/a | n/a | GCTGTTCTAAGCGAGA | eekd$_{10}$kke | 31 | 9976 | 9991 | 1885 |
| 548348 | n/a | n/a | TGAGTGATGCCTTCCA | eekd$_{10}$kke | 82 | 10024 | 10039 | 1886 |
| 548349 | n/a | n/a | TCCAGAATACTGCCCC | eekd$_{10}$kke | 61 | 10054 | 10069 | 1887 |

TABLE 27-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 548350 | n/a | n/a | GCGCTAACCTCATAAA | eekd$_{10}$kke | 29 | 10148 | 10163 | 1888 |
| 548351 | n/a | n/a | CTGGAAACGAGACACA | eekd$_{10}$kke | 33 | 10201 | 10216 | 1889 |
| 548352 | n/a | n/a | GAGAGAGATGTTCCCT | eekd$_{10}$kke | 47 | 10240 | 10255 | 1890 |
| 548353 | n/a | n/a | CTGCTGGTTGAGAATC | eekd$_{10}$kke | 48 | 10287 | 10302 | 1891 |
| 548354 | n/a | n/a | ATGTCCCCAGTGGAAG | eekd$_{10}$kke | 41 | 10314 | 10329 | 1892 |
| 548355 | n/a | n/a | GCATCCTCCCTAGTTG | eekd$_{10}$kke | 47 | 10362 | 10377 | 1893 |
| 548356 | n/a | n/a | TGTTGGTCAGCATTCA | eekd$_{10}$kke | 63 | 10411 | 10426 | 1894 |
| 548357 | n/a | n/a | GACGACTGCCCTGTGC | eekd$_{10}$kke | 69 | 10436 | 10451 | 1895 |
| 548358 | n/a | n/a | ATTTGGGCCTAGTGGT | eekd$_{10}$kke | 0 | 10515 | 10530 | 1896 |
| 548359 | n/a | n/a | CCTAGTCCTCAAGTTT | eekd$_{10}$kke | 0 | 10580 | 10595 | 1897 |
| 548360 | n/a | n/a | CAAGACATCAGTAGCT | eekd$_{10}$kke | 45 | 10626 | 10641 | 1898 |
| 548361 | n/a | n/a | CTTATCAGTCCCAGTC | eekd$_{10}$kke | 52 | 10702 | 10717 | 1899 |
| 548362 | n/a | n/a | GACAACCCATCAGTTG | eekd$_{10}$kke | 33 | 10742 | 10757 | 1900 |
| 548363 | n/a | n/a | CAGCAGGCTCAAAGTG | eekd$_{10}$kke | 37 | 10915 | 10930 | 1901 |
| 548364 | n/a | n/a | TGGCTAAGTCAGGCCC | eekd$_{10}$kke | 30 | 10982 | 10997 | 1902 |
| 548365 | n/a | n/a | TGTACTCCACCTCACG | eekd$_{10}$kke | 55 | 11017 | 11032 | 1903 |
| 548366 | n/a | n/a | AGCAAGCTAAGTGAGT | eekd$_{10}$kke | 5 | 11199 | 11214 | 1904 |
| 548367 | n/a | n/a | GTTCTTGAGTGTAGAG | eekd$_{10}$kke | 52 | 11260 | 11275 | 1905 |
| 548368 | n/a | n/a | GTGTTCATACGGAAGC | eekd$_{10}$kke | 59 | 11299 | 11314 | 1906 |
| 548369 | n/a | n/a | GTTGGGATGCGACTCT | eekd$_{10}$kke | 50 | 11335 | 11350 | 1907 |
| 548370 | n/a | n/a | ACGAAGTCTCTTTCCT | eekd$_{10}$kke | 53 | 11385 | 11400 | 1908 |
| 548371 | n/a | n/a | CGATGAGTTGGGCAGG | eekd$_{10}$kke | 57 | 11454 | 11469 | 1909 |
| 548372 | n/a | n/a | GATACCTTTCCACTCC | eekd$_{10}$kke | 61 | 11558 | 11573 | 1910 |
| 548373 | n/a | n/a | TCCCCAAGATTATGTG | eekd$_{10}$kke | 16 | 11596 | 11611 | 1911 |
| 548374 | n/a | n/a | GCACCCTTTTCATTGA | eekd$_{10}$kke | 41 | 12074 | 12089 | 1912 |
| 548375 | n/a | n/a | TCGACTTCTCCTGTCT | eekd$_{10}$kke | 27 | 12199 | 12214 | 1913 |
| 548376 | n/a | n/a | GCCTTTGACCTTTCGC | eekd$_{10}$kke | 65 | 12261 | 12276 | 1914 |
| 548377 | n/a | n/a | GTGTGCTGAGGTTTGC | eekd$_{10}$kke | 80 | 12297 | 12312 | 1915 |
| 548378 | n/a | n/a | GCAAGATGCATGCAGC | eekd$_{10}$kke | 49 | 12393 | 12408 | 1916 |
| 548379 | n/a | n/a | ATCGAACTCTGCTTGA | eekd$_{10}$kke | 44 | 12477 | 12492 | 1917 |
| 548380 | n/a | n/a | GCCCAGTTTTGGCAAC | eekd$_{10}$kke | 7 | 12540 | 12555 | 1918 |
| 548381 | n/a | n/a | CCCACTACCATTTGGG | eekd$_{10}$kke | 0 | 12578 | 12593 | 1919 |

TABLE 28

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 531231 | n/a | n/a | TATCACTGTACTAGTTTCCT | eeeeed$_{10}$eeeee | 46 | 14744 14815 14886 14945 15005 15077 15220 15292 15351 15411 15483 15555 15613 15685 15815 15887 15945 | 14763 14834 14905 14964 15024 15096 15239 15311 15370 15430 15502 15574 15632 15704 15834 15906 15964 | 334 |
| 547747 | n/a | n/a | TCACTGTACTAGTTTC | eekd$_{10}$kke | 64 | 14746 14817 14888 14947 15007 15079 15222 15294 15353 15413 15485 15557 15615 15687 15817 15889 15947 | 14761 14832 14903 14962 15022 15094 15237 15309 15368 15428 15500 15572 15630 15702 15832 15904 15962 | 1267 |
| 548459 | n/a | n/a | CAACTATAACAGTATC | eekd$_{10}$kke | 26 | 15903 | 15918 | 1920 |
| 548460 | n/a | n/a | CTATACCACGGTAACT | eekd$_{10}$kke | 0 | 16036 | 16051 | 1921 |
| 548461 | n/a | n/a | CCTATATCACTGTAAC | eekd$_{10}$kke | 0 | 16127 | 16142 | 1922 |
| 548462 | n/a | n/a | ACCTATATCACTGTAA | eekd$_{10}$kke | 0 | 16128 | 16143 | 1923 |
| 548463 | n/a | n/a | TCACTGTACCTATATC | eekd$_{10}$kke | 0 | 16135 | 16150 | 1924 |
| 548464 | n/a | n/a | GTCCTATAACTATATC | eekd$_{10}$kke | 0 | 16174 | 16189 | 1925 |
| 548465 | n/a | n/a | CTGTACCTATAACTGT | eekd$_{10}$kke | 0 | 16202 | 16217 | 1926 |
| 548466 | n/a | n/a | CGTCACTGTACCTATA | eekd$_{10}$kke | 71 | 16207 | 16222 | 1927 |
| 548467 | n/a | n/a | CATCACTGTACCTATA | eekd$_{10}$kke | 20 | 16258 | 16273 | 1928 |
| 548468 | n/a | n/a | CAACATCACTGTACCT | eekd$_{10}$kke | 6 | 16261 | 16276 | 1929 |
| 548469 | n/a | n/a | TTCCCTACCCCTGGTA | eekd$_{10}$kke | 0 | 16331 | 16346 | 1930 |
| 548470 | n/a | n/a | GGTGGAATGTCATGGC | eekd$_{10}$kke | 56 | 16404 | 16419 | 1931 |
| 548471 | n/a | n/a | GCGGAAAACTGGCCGT | eekd$_{10}$kke | 17 | 16474 | 16489 | 1932 |
| 548472 | n/a | n/a | CCCAATACAGGGCCAG | eekd$_{10}$kke | 0 | 16513 | 16528 | 1933 |
| 548473 | n/a | n/a | CCAACCTTCCCAATCT | eekd$_{10}$kke | 0 | 16554 | 16569 | 1934 |
| 548474 | n/a | n/a | GAAGGTGTGCTGTCGC | eekd$_{10}$kke | 33 | 16602 | 16617 | 1935 |
| 548475 | n/a | n/a | ATCGAGTCCTGCCTCC | eekd$_{10}$kke | 17 | 16707 | 16722 | 1936 |
| 548476 | n/a | n/a | GCAAATCCTTCCAGCA | eekd$_{10}$kke | 27 | 16755 | 16770 | 1937 |
| 548477 | n/a | n/a | GCACGAGCTTGCCTGT | eekd$_{10}$kke | 26 | 16787 | 16802 | 1938 |

TABLE 28-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 548478 | n/a | n/a | GAGCCATCCAGGGTGC | eekd$_{10}$kke | 53 | 16845 | 16860 | 1939 |
| 548479 | n/a | n/a | AGGCCATTTGATCCGA | eekd$_{10}$kke | 68 | 16913 | 16928 | 1940 |
| 548480 | n/a | n/a | GCCACGCCCTTAGCAG | eekd$_{10}$kke | 20 | 16973 | 16988 | 1941 |
| 548481 | n/a | n/a | GTTCCCTGAGGAACGG | eekd$_{10}$kke | 2 | 17010 | 17025 | 1942 |
| 548482 | n/a | n/a | GGCAGTTAGGCCAGGA | eekd$_{10}$kke | 53 | 17068 | 17083 | 1943 |
| 548483 | n/a | n/a | CTACAGATCATCCCTA | eekd$_{10}$kke | 5 | 17102 | 17117 | 1944 |
| 548484 | n/a | n/a | CCCCGGAGCACCTTCA | eekd$_{10}$kke | 41 | 17207 | 17222 | 1945 |
| 548485 | n/a | n/a | GTGACCCAAGGGTCGA | eekd$_{10}$kke | 17 | 17252 | 17267 | 1946 |
| 548486 | n/a | n/a | CGTGGTTAGCCTGACA | eekd$_{10}$kke | 68 | 17416 | 17431 | 1947 |
| 548487 | n/a | n/a | TCCATGTCAGAGTTGC | eekd$_{10}$kke | 71 | 17461 | 17476 | 1948 |
| 548488 | n/a | n/a | CCTCCTTTTGGCTTGA | eekd$_{10}$kke | 63 | 17530 | 17545 | 1949 |
| 548489 | n/a | n/a | TTCCCCAGAGGTGATA | eekd$_{10}$kke | 16 | 17582 | 17597 | 1950 |
| 548490 | n/a | n/a | TCTGGTTAGCCTCCGA | eekd$_{10}$kke | 58 | 17664 | 17679 | 1951 |
| 548491 | n/a | n/a | TGGCCAAGCAACCAGT | eekd$_{10}$kke | 57 | 17715 | 17730 | 1952 |
| 548492 | n/a | n/a | GCCCAATGTCCTAACC | eekd$_{10}$kke | 51 | 17794 | 17809 | 1953 |
| 548493 | n/a | n/a | CCACCGCTGCCCGCCA | eekd$_{10}$kke | 37 | 18013 | 18028 | 1954 |
| 548494 | n/a | n/a | TGTGACCCCCCACCGC | eekd$_{10}$kke | 39 | 18022 | 18037 | 1955 |
| 548495 | n/a | n/a | TTGTGACCCCCCACCG | eekd$_{10}$kke | 55 | 18023 | 18038 | 1956 |
| 548496 | n/a | n/a | ACTGAACCCCCTTAGG | eekd$_{10}$kke | 0 | 18571 | 18586 | 1957 |
| 548497 | n/a | n/a | CCTTCATACCCCTCAC | eekd$_{10}$kke | 26 | 18725 | 18740 | 1958 |
| 548498 | n/a | n/a | CCGATAACAGACCGGC | eekd$_{10}$kke | 71 | 18795 | 18810 | 1959 |
| 548499 | n/a | n/a | ATACCCGGAGTCAGGA | eekd$_{10}$kke | 56 | 18955 | 18970 | 1960 |
| 548500 | n/a | n/a | ATTGCTCAGGCCCCCT | eekd$_{10}$kke | 29 | 19037 | 19052 | 1961 |
| 548501 | n/a | n/a | CAAGCCACTAACCCAC | eekd$_{10}$kke | 33 | 19147 | 19162 | 1962 |
| 548502 | n/a | n/a | AATTCTTGGACCAAGG | eekd$_{10}$kke | 25 | 19234 | 19249 | 1963 |
| 548503 | n/a | n/a | CCATCTACTCCCCCAT | eekd$_{10}$kke | 9 | 19291 | 19306 | 1964 |
| 548504 | n/a | n/a | GCAGCGAGCATTCCAA | eekd$_{10}$kke | 28 | 19352 | 19367 | 1965 |
| 548505 | n/a | n/a | GGACAATGCCTATGCT | eekd$_{10}$kke | 21 | 19386 | 19401 | 1966 |
| 548506 | n/a | n/a | GAAGCCATTCACTGCA | eekd$_{10}$kke | 32 | 19436 | 19451 | 1967 |
| 548507 | n/a | n/a | AAACTCCTCTCAAGGC | eekd$_{10}$kke | 53 | 19474 | 19489 | 1968 |
| 548508 | n/a | n/a | GCACCACCATGCGGTT | eekd$_{10}$kke | 43 | 19553 | 19568 | 1969 |
| 548509 | n/a | n/a | TGCAGGGCTGCGCAGT | eekd$_{10}$kke | 41 | 19960 | 19975 | 1970 |
| 548510 | n/a | n/a | TTAGCCACTCCTCTTG | eekd$_{10}$kke | 30 | 20062 | 20077 | 1971 |
| 548511 | n/a | n/a | AGCTAGCTGACCCCAA | eekd$_{10}$kke | 16 | 20092 | 20107 | 1972 |
| 548512 | n/a | n/a | TCCGCCTTTGGATACT | eekd$_{10}$kke | 49 | 20155 | 20170 | 1973 |
| 548513 | n/a | n/a | CCTGCTGATTGTGTCT | eekd$_{10}$kke | 16 | 20240 | 20255 | 1974 |

TABLE 28-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 548514 | n/a | n/a | TCGAGGACAGCCCCCA | eekd$_{10}$kke | 40 | 20335 | 20350 | 1975 |
| 548515 | n/a | n/a | ACCCGTCAGCCTCAGC | eekd$_{10}$kke | 59 | 20381 | 20396 | 1976 |
| 548516 | n/a | n/a | CTTGCCTATTCACCCC | eekd$_{10}$kke | 49 | 20544 | 20559 | 1977 |
| 548517 | n/a | n/a | CGGACAAGCCTTACAG | eekd$_{10}$kke | 43 | 20596 | 20611 | 1978 |
| 548518 | n/a | n/a | CACACTTACCCCGCTC | eekd$_{10}$kke | 12 | 20741 | 20756 | 1979 |
| 548519 | n/a | n/a | CCTCCCCTTGTGTGTC | eekd$_{10}$kke | 31 | 20843 | 20858 | 1980 |
| 548520 | n/a | n/a | CCGCTTCCCTGACTGT | eekd$_{10}$kke | 43 | 20919 | 20934 | 1981 |
| 548521 | n/a | n/a | CAGCTCCCTTACTAGG | eekd$_{10}$kke | 61 | 20958 | 20973 | 1982 |
| 548522 | n/a | n/a | AGGTATTGACCGCCAG | eekd$_{10}$kke | 55 | 21062 | 21077 | 1983 |
| 548523 | n/a | n/a | GGTAAATCCATCCCCT | eekd$_{10}$kke | 44 | 21157 | 21172 | 1984 |
| 548524 | n/a | n/a | GCCCGATCACCTTAGA | eekd$_{10}$kke | 45 | 21220 | 21235 | 1985 |
| 548525 | n/a | n/a | GTCTAACTGGCCTGGC | eekd$_{10}$kke | 2 | 21328 | 21343 | 1986 |
| 548526 | n/a | n/a | CTAAGCTGTGTCTCAT | eekd$_{10}$kke | 26 | 21373 | 21388 | 1987 |
| 548527 | n/a | n/a | TGTTTCAAGTGCCAGA | eekd$_{10}$kke | 50 | 21434 | 21449 | 1988 |
| 548528 | n/a | n/a | TGCAGTGGTCAAGCAT | eekd$_{10}$kke | 32 | 21478 | 21493 | 1989 |
| 548529 | n/a | n/a | GCGATTCCTTGCCTCT | eekd$_{10}$kke | 56 | 21554 | 21569 | 1990 |
| 548530 | n/a | n/a | ATAATAGAGGCAGCCA | eekd$_{10}$kke | 50 | 21592 | 21607 | 1991 |
| 548531 | n/a | n/a | GTCAGAAGGCCTCTTA | eekd$_{10}$kke | 21 | 21753 | 21768 | 1992 |
| 548532 | n/a | n/a | TATTTATCCGACCTCT | eekd$_{10}$kke | 34 | 21881 | 21896 | 1993 |
| 548533 | n/a | n/a | GAGGTGGTTGGAGCTA | eekd$_{10}$kke | 9 | 21926 | 21941 | 1994 |
| 548534 | n/a | n/a | CAGATCCCAATTCTTC | eekd$_{10}$kke | 22 | 22063 | 22078 | 1995 |
| 548535 | n/a | n/a | GAGTCTTTCCAATCCT | eekd$_{10}$kke | 13 | 22142 | 22157 | 1996 |

TABLE 29

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 531231 | n/a | n/a | TATCACTGTACTAGTTTCCT | eeeeed$_{10}$eeeee | 46 | 14744 | 14763 | 334 |
|  |  |  |  |  |  | 14815 | 14834 |  |
|  |  |  |  |  |  | 14886 | 14905 |  |
|  |  |  |  |  |  | 14945 | 14964 |  |
|  |  |  |  |  |  | 15005 | 15024 |  |
|  |  |  |  |  |  | 15077 | 15096 |  |
|  |  |  |  |  |  | 15220 | 15239 |  |
|  |  |  |  |  |  | 15292 | 15311 |  |
|  |  |  |  |  |  | 15351 | 15370 |  |
|  |  |  |  |  |  | 15411 | 15430 |  |
|  |  |  |  |  |  | 15483 | 15502 |  |
|  |  |  |  |  |  | 15555 | 15574 |  |
|  |  |  |  |  |  | 15613 | 15632 |  |
|  |  |  |  |  |  | 15685 | 15704 |  |
|  |  |  |  |  |  | 15815 | 15834 |  |
|  |  |  |  |  |  | 15887 | 15906 |  |
|  |  |  |  |  |  | 15945 | 15964 |  |

TABLE 29-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 547747 | n/a | n/a | TCACTGTACTAGTTTC | eekd$_{10}$kke | 64 | 14746 | 14761 | 1267 |
| | | | | | | 14817 | 14832 | |
| | | | | | | 14888 | 14903 | |
| | | | | | | 14947 | 14962 | |
| | | | | | | 15007 | 15022 | |
| | | | | | | 15079 | 15094 | |
| | | | | | | 15222 | 15237 | |
| | | | | | | 15294 | 15309 | |
| | | | | | | 15353 | 15368 | |
| | | | | | | 15413 | 15428 | |
| | | | | | | 15485 | 15500 | |
| | | | | | | 15557 | 15572 | |
| | | | | | | 15615 | 15630 | |
| | | | | | | 15687 | 15702 | |
| | | | | | | 15817 | 15832 | |
| | | | | | | 15889 | 15904 | |
| | | | | | | 15947 | 15962 | |
| 548536 | n/a | n/a | TCTCAATCCCAACCCC | eekd$_{10}$kke | 0 | 22168 | 22183 | 1997 |
| 548537 | n/a | n/a | CCTCAATCCCAACCCA | eekd$_{10}$kke | 0 | 22191 | 22206 | 1998 |
| 548538 | n/a | n/a | TAGTGGCAAGAACCAC | eekd$_{10}$kke | 0 | 22627 | 22642 | 1999 |
| 548539 | n/a | n/a | CGCGCGAATGCCTGCC | eekd$_{10}$kke | 41 | 22658 | 22673 | 2000 |
| 548540 | n/a | n/a | GACACCTGCTTGATTA | eekd$_{10}$kke | 7 | 22704 | 22719 | 2001 |
| 548541 | n/a | n/a | GGCACTGGTCATGGAC | eekd$_{10}$kke | 39 | 22760 | 22775 | 2002 |
| 548542 | n/a | n/a | GCGCCATCCTTCAATC | eekd$_{10}$kke | 7 | 22857 | 22872 | 2003 |
| 548543 | n/a | n/a | GATCCACCCATGACCT | eekd$_{10}$kke | 32 | 22997 | 23012 | 2004 |
| 548544 | n/a | n/a | GCTGTGACTCAGATCA | eekd$_{10}$kke | 62 | 23070 | 23085 | 2005 |
| 548545 | n/a | n/a | CTCTTCGCATGGACAC | eekd$_{10}$kke | 46 | 23100 | 23115 | 2006 |
| 548546 | n/a | n/a | GCCCAAGCCTACATGC | eekd$_{10}$kke | 35 | 23430 | 23445 | 2007 |
| 548547 | n/a | n/a | GTGCGATTAAGCCCCA | eekd$_{10}$kke | 86 | 23514 | 23529 | 2008 |
| 548548 | n/a | n/a | GCTTGTAGAAGGGATT | eekd$_{10}$kke | 54 | 23631 | 23646 | 2009 |
| 548549 | n/a | n/a | TGTGCAATCAGGTGGA | eekd$_{10}$kke | 56 | 23765 | 23780 | 2010 |
| 548550 | n/a | n/a | CCGGCCTGGATACAGC | eekd$_{10}$kke | 0 | 23831 | 23846 | 2011 |
| 548551 | n/a | n/a | CGGCCAATGGGAAAGG | eekd$_{10}$kke | 25 | 24175 | 24190 | 2012 |
| 548552 | n/a | n/a | TGGAGGAGTAGGGAAT | eekd$_{10}$kke | 10 | 24200 | 24215 | 2013 |
| 548553 | n/a | n/a | CCCGAAGAGTCAAGTC | eekd$_{10}$kke | 46 | 24255 | 24270 | 2014 |
| 548554 | n/a | n/a | GTGCTGCATTGCATGA | eekd$_{10}$kke | 42 | 24290 | 24305 | 2015 |
| 548555 | n/a | n/a | ACACGCCAGGTGAAAA | eekd$_{10}$kke | 2 | 24322 | 24337 | 2016 |
| 548556 | n/a | n/a | ATGCATGCCTACCCAA | eekd$_{10}$kke | 43 | 24526 | 24541 | 2017 |
| 548557 | n/a | n/a | GTTACTCTGTGATCCA | eekd$_{10}$kke | 81 | 24581 | 24596 | 2018 |
| 548558 | n/a | n/a | AACATTGTGTAGCTGC | eekd$_{10}$kke | 75 | 24640 | 24655 | 2019 |
| 548559 | n/a | n/a | GAGACTGAAGCCCTCA | eekd$_{10}$kke | 44 | 24676 | 24691 | 2020 |
| 548560 | n/a | n/a | CACTGCCTAGAAAGGC | eekd$_{10}$kke | 16 | 24734 | 24749 | 2021 |
| 548561 | n/a | n/a | TGTAGTATCCAGAGTA | eekd$_{10}$kke | 46 | 24930 | 24945 | 2022 |
| 548562 | n/a | n/a | AGATGACCTGCAGATG | eekd$_{10}$kke | 50 | 24983 | 24998 | 2023 |

TABLE 29-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 548563 | n/a | n/a | AAACCATGAATTAGGT | eekd$_{10}$kke | 20 | 25100 | 25115 | 2024 |
| 548564 | n/a | n/a | TTGCTACTTTACACCA | eekd$_{10}$kke | 69 | 25208 | 25223 | 2025 |
| 548565 | n/a | n/a | GGCATTAGGATAGGCA | eekd$_{10}$kke | 63 | 25350 | 25365 | 2026 |
| 548566 | n/a | n/a | CACTCAGACTGTCTGA | eekd$_{10}$kke | 0 | 25413 | 25428 | 2027 |
| 548567 | n/a | n/a | AGATCCGGAATAACCA | eekd$_{10}$kke | 67 | 25459 | 25474 | 2028 |
| 548568 | n/a | n/a | ATTGACAACCATCCTA | eekd$_{10}$kke | 27 | 25496 | 25511 | 2029 |
| 548569 | n/a | n/a | ACTCATTGGTCTACAG | eekd$_{10}$kke | 41 | 25559 | 25574 | 2030 |
| 548570 | n/a | n/a | ATGCCTTGTGCCTATT | eekd$_{10}$kke | 74 | 25706 | 25721 | 2031 |
| 548571 | n/a | n/a | ACTCTGAGGCCTTAGG | eekd$_{10}$kke | 59 | 25794 | 25809 | 2032 |
| 548572 | n/a | n/a | GCATTACTCAGCATGT | eekd$_{10}$kke | 63 | 25836 | 25851 | 2033 |
| 548573 | n/a | n/a | CCAGTCACCACCATTG | eekd$_{10}$kke | 65 | 25862 | 25877 | 2034 |
| 548574 | n/a | n/a | GGTCTAACTCTAAGGG | eekd$_{10}$kke | 0 | 25920 | 25935 | 2035 |
| 548575 | n/a | n/a | TGTCCTTTAAAGTATC | eekd$_{10}$kke | 18 | 25971 | 25986 | 2036 |
| 548576 | n/a | n/a | TCATGTGGCAACCTGT | eekd$_{10}$kke | 41 | 26114 | 26129 | 2037 |
| 548577 | n/a | n/a | AATCTGCACCTGGCAG | eekd$_{10}$kke | 42 | 26428 | 26443 | 2038 |
| 548578 | n/a | n/a | CATGGCTATTGCTTCC | eekd$_{10}$kke | 73 | 26513 | 26528 | 2039 |
| 548579 | n/a | n/a | GGGCTATATTGCCAGC | eekd$_{10}$kke | 46 | 26614 | 26629 | 2040 |
| 548580 | n/a | n/a | CCAGAGCCTTGATCAG | eekd$_{10}$kke | 36 | 26681 | 26696 | 2041 |
| 548581 | n/a | n/a | GGTGGGTTATCTGAGA | eekd$_{10}$kke | 13 | 26710 | 26725 | 2042 |
| 548582 | n/a | n/a | TAGCTCCATGCTGTGT | eekd$_{10}$kke | 59 | 26735 | 26750 | 2043 |
| 548583 | n/a | n/a | GGGAATTTATGCTGCC | eekd$_{10}$kke | 79 | 26782 | 26797 | 2044 |
| 548584 | n/a | n/a | TGATGAAGTTCCACCT | eekd$_{10}$kke | 47 | 26840 | 26855 | 2045 |
| 548585 | n/a | n/a | TAGGCACAGACAACCT | eekd$_{10}$kke | 33 | 26869 | 26884 | 2046 |
| 548586 | n/a | n/a | TCCAACTACAGGACTC | eekd$_{10}$kke | 39 | 26943 | 26958 | 2047 |
| 548587 | n/a | n/a | TTCTGGGAAACTCTCT | eekd$_{10}$kke | 45 | 26969 | 26984 | 2048 |
| 548588 | n/a | n/a | AGCTCACACCCAAAAA | eekd$_{10}$kke | 10 | 27006 | 27021 | 2049 |
| 548589 | n/a | n/a | TCTGTTACCTTGAGGA | eekd$_{10}$kke | 40 | 27280 | 27295 | 2050 |
| 548590 | n/a | n/a | TGGTCATGTCAACTGT | eekd$_{10}$kke | 35 | 27550 | 27565 | 2051 |
| 548591 | n/a | n/a | GTAAGCCTTCACAGGG | eekd$_{10}$kke | 3 | 27583 | 27598 | 2052 |
| 548592 | n/a | n/a | CTCACCAGAGTTGTCC | eekd$_{10}$kke | 7 | 27726 | 27741 | 2053 |
| 548593 | n/a | n/a | CATCCCTGACAGGTCC | eekd$_{10}$kke | 61 | 27759 | 27774 | 2054 |
| 548594 | n/a | n/a | CCCTTCTAACCAAGGA | eekd$_{10}$kke | 30 | 27825 | 27840 | 2055 |
| 548595 | n/a | n/a | GGATGAGATGCATCCA | eekd$_{10}$kke | 8 | 28069 | 28084 | 2056 |
| 548596 | n/a | n/a | ATGGCGGTGAAGCAGC | eekd$_{10}$kke | 20 | 28127 | 28142 | 2057 |
| 548597 | n/a | n/a | TGAATACCATCCCCGC | eekd$_{10}$kke | 50 | 28171 | 28186 | 2058 |
| 548598 | n/a | n/a | GCGCCATCTGCCCTGT | eekd$_{10}$kke | 50 | 28253 | 28268 | 2059 |
| 548599 | n/a | n/a | TGGGTTGGAGGAGTGG | eekd$_{10}$kke | 19 | 28311 | 28326 | 2060 |

TABLE 29-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 548600 | n/a | n/a | TGGTGGTGGGATTGGT | eekd$_{10}$kke | 53 | 28336 28391 28434 28446 28525 28611 28623 | 28351 28406 28449 28461 28540 28626 28638 | 2061 |
| 548601 | n/a | n/a | TTGGTGGTGGGATTGG | eekd$_{10}$kke | 18 | 28337 28392 28435 28447 28526 28612 28624 | 28352 28407 28450 28462 28541 28627 28639 | 2062 |
| 548602 | n/a | n/a | GGTGGTGGAATTGGTG | eekd$_{10}$kke | 20 | 28347 | 28362 | 2063 |
| 548603 | n/a | n/a | GAGATTGGTGGTGGGT | eekd$_{10}$kke | 35 | 28372 | 28387 | 2064 |
| 548604 | n/a | n/a | GTGGTGGGATTGGTGC | eekd$_{10}$kke | 22 | 28432 | 28447 | 2065 |
| 548605 | n/a | n/a | TGGCGGGATTGGTGGT | eekd$_{10}$kke | 12 | 28479 28558 | 28494 28573 | 2066 |
| 548606 | n/a | n/a | CGGTGGTGGGATTGGT | eekd$_{10}$kke | 41 | 28501 28580 | 28516 28595 | 2067 |
| 548607 | n/a | n/a | TCGGTGGTGGGATTGG | eekd$_{10}$kke | 34 | 28502 28581 | 28517 28596 | 2068 |
| 548608 | n/a | n/a | ATCGGTGGTGGGATTG | eekd$_{10}$kke | 25 | 28503 28582 | 28518 28597 | 2069 |
| 548609 | n/a | n/a | GATCGGTGGTGGGATT | eekd$_{10}$kke | 30 | 28504 28583 | 28519 28598 | 2070 |
| 548610 | n/a | n/a | GGATCGGTGGTGGGAT | eekd$_{10}$kke | 2 | 28505 28584 | 28520 28599 | 2071 |
| 548611 | n/a | n/a | GCGGGATCGGTGGTGG | eekd$_{10}$kke | 7 | 28508 28587 | 28523 28602 | 2072 |
| 548612 | n/a | n/a | GGCGGGATCGGTGGTG | eekd$_{10}$kke | 20 | 28509 28588 | 28524 28603 | 2073 |

TABLE 30

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 531231 | n/a | n/a | TATCACTGTACTAGTTTCCT | eeeeed$_{10}$eeeee | 46 | 14744 14815 14886 14945 15005 15077 15220 15292 15351 15411 15483 15555 15613 15685 | 14763 14834 14905 14964 15024 15096 15239 15311 15370 15430 15502 15574 15632 15704 | 334 |

TABLE 30-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| | | | | | | 15815 | 15834 | |
| | | | | | | 15887 | 15906 | |
| | | | | | | 15945 | 15964 | |
| 547747 | n/a | n/a | TCACTGTACTAGTTTC | eekd$_{10}$kke | 64 | 14746 | 14761 | 1267 |
| | | | | | | 14817 | 14832 | |
| | | | | | | 14888 | 14903 | |
| | | | | | | 14947 | 14962 | |
| | | | | | | 15007 | 15022 | |
| | | | | | | 15079 | 15094 | |
| | | | | | | 15222 | 15237 | |
| | | | | | | 15294 | 15309 | |
| | | | | | | 15353 | 15368 | |
| | | | | | | 15413 | 15428 | |
| | | | | | | 15485 | 15500 | |
| | | | | | | 15557 | 15572 | |
| | | | | | | 15615 | 15630 | |
| | | | | | | 15687 | 15702 | |
| | | | | | | 15817 | 15832 | |
| | | | | | | 15889 | 15904 | |
| | | | | | | 15947 | 15962 | |
| 548382 | n/a | n/a | GAGCAAATACAGTCCA | eekd$_{10}$kke | 19 | 12620 | 12635 | 2074 |
| 548383 | n/a | n/a | GTCTCGATGGCAAGCT | eekd$_{10}$kke | 49 | 12654 | 12669 | 2075 |
| 548384 | n/a | n/a | CTCACCGGTACTCTGC | eekd$_{10}$kke | 49 | 12805 | 12820 | 2076 |
| 548385 | n/a | n/a | TCCTGGAGGCACCAAT | eekd$_{10}$kke | 0 | 12847 | 12862 | 2077 |
| 548386 | n/a | n/a | AGCCCTGTTTGGTTTT | eekd$_{10}$kke | 0 | 12903 | 12918 | 2078 |
| 548387 | n/a | n/a | TGAAGGGCGAGGCGCA | eekd$_{10}$kke | 22 | 13261 | 13276 | 2079 |
| 548388 | n/a | n/a | AAGAGGATGTCAGGCT | eekd$_{10}$kke | 4 | 13357 | 13372 | 2080 |
| 548389 | n/a | n/a | TTGAGGAAAGACCTGC | eekd$_{10}$kke | 11 | 13399 | 13414 | 2081 |
| 548390 | n/a | n/a | GCTGAGTGTGACTTAA | eekd$_{10}$kke | 43 | 13455 | 13470 | 2082 |
| 548391 | n/a | n/a | GTACATGACTCCAGTG | eekd$_{10}$kke | 34 | 13638 | 13653 | 2083 |
| 548392 | n/a | n/a | GTAGAGCATGGAGCGA | eekd$_{10}$kke | 31 | 13730 | 13745 | 2084 |
| 548393 | n/a | n/a | CGCTTCAGGAAAGCGA | eekd$_{10}$kke | 26 | 13828 | 13843 | 2085 |
| 548394 | n/a | n/a | GGCAGGAGACTCCGTG | eekd$_{10}$kke | 25 | 13919 | 13934 | 2086 |
| 548395 | n/a | n/a | ATCCTTCCCCTCGCAA | eekd$_{10}$kke | 0 | 13966 | 13981 | 2087 |
| 548396 | n/a | n/a | TAATGAGTGGGTTAGG | eekd$_{10}$kke | 0 | 14007 | 14022 | 2088 |
| 548397 | n/a | n/a | GGAGCAGTGCAGGTAA | eekd$_{10}$kke | 1 | 14065 | 14080 | 2089 |
| 548398 | n/a | n/a | ATAGGCAATTGTTCCT | eekd$_{10}$kke | 55 | 14129 | 14144 | 2090 |
| 548399 | n/a | n/a | AGTCCTACAATTACCA | eekd$_{10}$kke | 11 | 14239 | 14254 | 2091 |
| 548400 | n/a | n/a | GGGCTCCTATTCCACC | eekd$_{10}$kke | 13 | 14277 | 14292 | 2092 |
| 548401 | n/a | n/a | GCCAGCTATGGGAACA | eekd$_{10}$kke | 71 | 14333 | 14348 | 2093 |
| 548402 | n/a | n/a | CCCCATCTCGAAGCCC | eekd$_{10}$kke | 45 | 14380 | 14395 | 2094 |
| 548403 | n/a | n/a | GAGTACATTGGGCCCA | eekd$_{10}$kke | 25 | 14418 | 14433 | 2095 |
| 548404 | n/a | n/a | GAGCCTTCCGCCTCTC | eekd$_{10}$kke | 37 | 14471 | 14486 | 2096 |
| 548405 | n/a | n/a | CGGACCTTCATCTTCA | eekd$_{10}$kke | 35 | 14529 | 14544 | 2097 |
| 548406 | n/a | n/a | TCTAGAGGCCGCCTGC | eekd$_{10}$kke | 0 | 14558 | 14573 | 2098 |
| 548407 | n/a | n/a | CCTATAACTGCTGCTC | eekd$_{10}$kke | 24 | 14731 | 14746 | 2099 |

TABLE 30-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 548408 | n/a | n/a | TATCACTGTACTAGTT | eekd$_{10}$kke | 47 | 14748 14819 14890 14949 15009 15081 15153 15224 15296 15355 15415 15487 15559 15617 15689 15819 15891 15949 | 14763 14834 14905 14964 15024 15096 15168 15239 15311 15370 15430 15502 15574 15632 15704 15834 15906 15964 | 1269 |
| 548409 | n/a | n/a | GTATCACTGTACTAGT | eekd$_{10}$kke | 81 | 14749 14820 14891 14950 15010 15082 15154 15225 15297 15356 15416 15488 15560 15618 15690 15820 15892 15950 | 14764 14835 14906 14965 15025 15097 15169 15240 15312 15371 15431 15503 15575 15633 15705 15835 15907 15965 | 2100 |
| 548410 | n/a | n/a | AGTATCACTGTACTAG | eekd$_{10}$kke | 85 | 14750 14821 14892 14951 15011 15083 15155 15226 15298 15357 15417 15489 15561 15619 15691 15821 15893 15951 | 14765 14836 14907 14966 15026 15098 15170 15241 15313 15372 15432 15504 15576 15634 15706 15836 15908 15966 | 2101 |
| 548411 | n/a | n/a | CAGTATCACTGTACTA | eekd$_{10}$kke | 72 | 14751 14822 14893 14952 15012 15084 15156 15227 15299 15358 15418 15490 15562 15620 15692 | 14766 14837 14908 14967 15027 15099 15171 15242 15314 15373 15433 15505 15577 15635 15707 | 2102 |

TABLE 30-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| | | | | | | 15822 | 15837 | |
| | | | | | | 15894 | 15909 | |
| | | | | | | 15952 | 15967 | |
| 548412 | n/a | n/a | TAACAGTATCACTGTA | eekd$_{10}$kke | 17 | 14754 | 14769 | 2103 |
| | | | | | | 14825 | 14840 | |
| | | | | | | 14896 | 14911 | |
| | | | | | | 14955 | 14970 | |
| | | | | | | 15015 | 15030 | |
| | | | | | | 15087 | 15102 | |
| | | | | | | 15159 | 15174 | |
| | | | | | | 15230 | 15245 | |
| | | | | | | 15302 | 15317 | |
| | | | | | | 15361 | 15376 | |
| | | | | | | 15421 | 15436 | |
| | | | | | | 15493 | 15508 | |
| | | | | | | 15565 | 15580 | |
| | | | | | | 15623 | 15638 | |
| | | | | | | 15695 | 15710 | |
| | | | | | | 15825 | 15840 | |
| | | | | | | 15897 | 15912 | |
| | | | | | | 15955 | 15970 | |
| 548413 | n/a | n/a | CTAACAGTATCACTGT | eekd$_{10}$kke | 55 | 14755 | 14770 | 2104 |
| | | | | | | 14826 | 14841 | |
| | | | | | | 14897 | 14912 | |
| | | | | | | 15016 | 15031 | |
| | | | | | | 15088 | 15103 | |
| | | | | | | 15231 | 15246 | |
| | | | | | | 15303 | 15318 | |
| | | | | | | 15422 | 15437 | |
| | | | | | | 15494 | 15509 | |
| | | | | | | 15624 | 15639 | |
| | | | | | | 15826 | 15841 | |
| | | | | | | 15956 | 15971 | |
| 548414 | n/a | n/a | TCTAACAGTATCACTG | eekd$_{10}$kke | 20 | 14756 | 14771 | 2105 |
| | | | | | | 14827 | 14842 | |
| | | | | | | 14898 | 14913 | |
| | | | | | | 15017 | 15032 | |
| | | | | | | 15089 | 15104 | |
| | | | | | | 15232 | 15247 | |
| | | | | | | 15304 | 15319 | |
| | | | | | | 15423 | 15438 | |
| | | | | | | 15495 | 15510 | |
| | | | | | | 15625 | 15640 | |
| | | | | | | 15827 | 15842 | |
| | | | | | | 15957 | 15972 | |
| 548415 | n/a | n/a | ATAACTCTAACAGTAT | eekd$_{10}$kke | 0 | 14761 | 14776 | 2106 |
| | | | | | | 14832 | 14847 | |
| | | | | | | 14903 | 14918 | |
| | | | | | | 15022 | 15037 | |
| | | | | | | 15094 | 15109 | |
| | | | | | | 15237 | 15252 | |
| | | | | | | 15309 | 15324 | |
| | | | | | | 15428 | 15443 | |
| | | | | | | 15500 | 15515 | |
| | | | | | | 15630 | 15645 | |
| | | | | | | 15832 | 15847 | |
| | | | | | | 15962 | 15977 | |
| 548416 | n/a | n/a | CTATAACTCTAACAGT | eekd$_{10}$kke | 9 | 14763 | 14778 | 2107 |
| | | | | | | 14834 | 14849 | |
| | | | | | | 14905 | 14920 | |
| | | | | | | 15024 | 15039 | |
| | | | | | | 15096 | 15111 | |
| | | | | | | 15239 | 15254 | |
| | | | | | | 15311 | 15326 | |
| | | | | | | 15430 | 15445 | |
| | | | | | | 15502 | 15517 | |

TABLE 30-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| | | | | | | 15632 | 15647 | |
| | | | | | | 15834 | 15849 | |
| | | | | | | 15964 | 15979 | |
| 548417 | n/a | n/a | ACTGTCCTATAACTCT | eekd$_{10}$kke | 24 | 14769 | 14784 | 2108 |
| | | | | | | 14840 | 14855 | |
| 548418 | n/a | n/a | TATATCACTGTCCTAT | eekd$_{10}$kke | 39 | 14775 | 14790 | 2109 |
| | | | | | | 14846 | 14861 | |
| | | | | | | 15180 | 15195 | |
| | | | | | | 15716 | 15731 | |
| | | | | | | 16164 | 16179 | |
| 548419 | n/a | n/a | CCTATATCACTGTCCT | eekd$_{10}$kke | 52 | 14777 | 14792 | 2110 |
| | | | | | | 14848 | 14863 | |
| | | | | | | 15182 | 15197 | |
| | | | | | | 15718 | 15733 | |
| 548420 | n/a | n/a | TCCTATATCACTGTCC | eekd$_{10}$kke | 58 | 14778 | 14793 | 2111 |
| | | | | | | 14849 | 14864 | |
| | | | | | | 15183 | 15198 | |
| | | | | | | 15719 | 15734 | |
| 548421 | n/a | n/a | CACTGTCCTATATCAC | eekd$_{10}$kke | 56 | 14783 | 14798 | 2112 |
| | | | | | | 14854 | 14869 | |
| | | | | | | 14979 | 14994 | |
| | | | | | | 15117 | 15132 | |
| | | | | | | 15188 | 15203 | |
| | | | | | | 15260 | 15275 | |
| | | | | | | 15385 | 15400 | |
| | | | | | | 15523 | 15538 | |
| | | | | | | 15653 | 15668 | |
| | | | | | | 15724 | 15739 | |
| | | | | | | 15855 | 15870 | |
| | | | | | | 15985 | 16000 | |
| 548422 | n/a | n/a | GTATCACTGTCCTATA | eekd$_{10}$kke | 69 | 14787 | 14802 | 2113 |
| | | | | | | 14983 | 14998 | |
| | | | | | | 15121 | 15136 | |
| | | | | | | 15389 | 15404 | |
| | | | | | | 15527 | 15542 | |
| | | | | | | 15989 | 16004 | |
| 548423 | n/a | n/a | AGTATCACTGTCCTAT | eekd$_{10}$kke | 72 | 14788 | 14803 | 2114 |
| | | | | | | 14984 | 14999 | |
| | | | | | | 15050 | 15065 | |
| | | | | | | 15122 | 15137 | |
| | | | | | | 15390 | 15405 | |
| | | | | | | 15456 | 15471 | |
| | | | | | | 15528 | 15543 | |
| | | | | | | 15990 | 16005 | |
| 548424 | n/a | n/a | CAGTATCACTGTCCTA | eekd$_{10}$kke | 90 | 14789 | 14804 | 2115 |
| | | | | | | 14985 | 15000 | |
| | | | | | | 15051 | 15066 | |
| | | | | | | 15123 | 15138 | |
| | | | | | | 15391 | 15406 | |
| | | | | | | 15457 | 15472 | |
| | | | | | | 15529 | 15544 | |
| | | | | | | 15991 | 16006 | |
| 548425 | n/a | n/a | AACAGTATCACTGTCC | eekd$_{10}$kke | 90 | 14791 | 14806 | 2116 |
| | | | | | | 14987 | 15002 | |
| | | | | | | 15053 | 15068 | |
| | | | | | | 15125 | 15140 | |
| | | | | | | 15393 | 15408 | |
| | | | | | | 15459 | 15474 | |
| | | | | | | 15531 | 15546 | |
| | | | | | | 15993 | 16008 | |
| 548426 | n/a | n/a | TATAACAGTATCACTG | eekd$_{10}$kke | 14 | 14794 | 14809 | 2117 |
| | | | | | | 14990 | 15005 | |
| | | | | | | 15056 | 15071 | |

TABLE 30-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| | | | | | | 15128 | 15143 | |
| | | | | | | 15161 | 15176 | |
| | | | | | | 15363 | 15378 | |
| | | | | | | 15396 | 15411 | |
| | | | | | | 15462 | 15477 | |
| | | | | | | 15534 | 15549 | |
| | | | | | | 15567 | 15582 | |
| | | | | | | 15697 | 15712 | |
| | | | | | | 15899 | 15914 | |
| | | | | | | 15996 | 16011 | |
| 548427 | n/a | n/a | CTATAACAGTATCACT | eekd$_{10}$kke | 24 | 14795 | 14810 | 2118 |
| | | | | | | 14991 | 15006 | |
| | | | | | | 15057 | 15072 | |
| | | | | | | 15129 | 15144 | |
| | | | | | | 15162 | 15177 | |
| | | | | | | 15364 | 15379 | |
| | | | | | | 15397 | 15412 | |
| | | | | | | 15463 | 15478 | |
| | | | | | | 15535 | 15550 | |
| | | | | | | 15568 | 15583 | |
| | | | | | | 15698 | 15713 | |
| | | | | | | 15900 | 15915 | |
| | | | | | | 15997 | 16012 | |
| 548428 | n/a | n/a | TAACTATAACAGTATC | eekd$_{10}$kke | 0 | 14798 | 14813 | 2119 |
| | | | | | | 15060 | 15075 | |
| | | | | | | 15132 | 15147 | |
| | | | | | | 15165 | 15180 | |
| | | | | | | 15466 | 15481 | |
| | | | | | | 15538 | 15553 | |
| | | | | | | 15571 | 15586 | |
| | | | | | | 15701 | 15716 | |
| | | | | | | 15772 | 15787 | |
| | | | | | | 16000 | 16015 | |
| 548429 | n/a | n/a | TATAACTATAACAGTA | eekd$_{10}$kke | 0 | 14800 | 14815 | 2120 |
| | | | | | | 15062 | 15077 | |
| | | | | | | 15134 | 15149 | |
| | | | | | | 15167 | 15182 | |
| | | | | | | 15468 | 15483 | |
| | | | | | | 15540 | 15555 | |
| | | | | | | 15573 | 15588 | |
| | | | | | | 15703 | 15718 | |
| | | | | | | 15774 | 15789 | |
| | | | | | | 16002 | 16017 | |
| 548430 | n/a | n/a | CCTATAACTATAACAG | eekd$_{10}$kke | 21 | 14802 | 14817 | 2121 |
| | | | | | | 15064 | 15079 | |
| | | | | | | 15169 | 15184 | |
| | | | | | | 15470 | 15485 | |
| | | | | | | 15542 | 15557 | |
| | | | | | | 15575 | 15590 | |
| | | | | | | 15705 | 15720 | |
| | | | | | | 15776 | 15791 | |
| | | | | | | 16004 | 16019 | |
| 548431 | n/a | n/a | TACCTATAACTCTAAC | eekd$_{10}$kke | 9 | 14908 | 14923 | 2122 |
| | | | | | | 15027 | 15042 | |
| | | | | | | 15099 | 15114 | |
| | | | | | | 15242 | 15257 | |
| | | | | | | 15314 | 15329 | |
| | | | | | | 15433 | 15448 | |
| | | | | | | 15505 | 15520 | |
| | | | | | | 15635 | 15650 | |
| | | | | | | 15837 | 15852 | |
| | | | | | | 15967 | 15982 | |
| 548432 | n/a | n/a | ACTGTACCTATAACTC | eekd$_{10}$kke | 43 | 14912 | 14927 | 2123 |
| | | | | | | 15031 | 15046 | |
| | | | | | | 15246 | 15261 | |
| | | | | | | 15318 | 15333 | |
| | | | | | | 15437 | 15452 | |

TABLE 30-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| | | | | | | 15509 | 15524 | |
| | | | | | | 15639 | 15654 | |
| | | | | | | 15841 | 15856 | |
| | | | | | | 15971 | 15986 | |
| 548433 | n/a | n/a | TATCACTGTACCTATA | eekd$_{10}$kke | 33 | 14916 | 14931 | 2124 |
| | | | | | | 15250 | 15265 | |
| | | | | | | 15322 | 15337 | |
| | | | | | | 15375 | 15390 | |
| | | | | | | 15513 | 15528 | |
| | | | | | | 15643 | 15658 | |
| | | | | | | 15786 | 15801 | |
| | | | | | | 15845 | 15860 | |
| | | | | | | 15975 | 15990 | |
| | | | | | | 16137 | 16152 | |
| 548434 | n/a | n/a | ACAATATCACTGTACC | eekd$_{10}$kke | 63 | 14920 | 14935 | 2125 |
| | | | | | | 15326 | 15341 | |
| | | | | | | 15790 | 15805 | |
| | | | | | | 16063 | 16078 | |
| | | | | | | 16141 | 16156 | |
| 548435 | n/a | n/a | AACAATATCACTGTAC | eekd$_{10}$kke | 19 | 14921 | 14936 | 2126 |
| | | | | | | 15327 | 15342 | |
| | | | | | | 15791 | 15806 | |
| | | | | | | 16064 | 16079 | |
| | | | | | | 16142 | 16157 | |
| 548436 | n/a | n/a | ATATCACTGTACCTGT | eekd$_{10}$kke | 8 | 14970 | 14985 | 2127 |
| 548437 | n/a | n/a | TATATCACTGTACCTG | eekd$_{10}$kke | 74 | 14971 | 14986 | 2128 |
| 548438 | n/a | n/a | CTATATCACTGTACCT | eekd$_{10}$kke | 38 | 14972 | 14987 | 2129 |
| | | | | | | 15253 | 15268 | |
| | | | | | | 15378 | 15393 | |
| | | | | | | 15516 | 15531 | |
| | | | | | | 15646 | 15661 | |
| | | | | | | 15848 | 15863 | |
| | | | | | | 15978 | 15993 | |
| 548439 | n/a | n/a | CCTATATCACTGTACC | eekd$_{10}$kke | 46 | 14973 | 14988 | 2130 |
| | | | | | | 15254 | 15269 | |
| | | | | | | 15379 | 15394 | |
| | | | | | | 15517 | 15532 | |
| | | | | | | 15647 | 15662 | |
| | | | | | | 15849 | 15864 | |
| | | | | | | 15979 | 15994 | |
| 548440 | n/a | n/a | CCTATAACAGTATCAC | eekd$_{10}$kke | 32 | 14992 | 15007 | 2131 |
| | | | | | | 15365 | 15380 | |
| | | | | | | 15398 | 15413 | |
| 548441 | n/a | n/a | TCCTATAACAGTATCA | eekd$_{10}$kke | 42 | 14993 | 15008 | 2132 |
| | | | | | | 15399 | 15414 | |
| 548442 | n/a | n/a | TTCCTATAACAGTATC | eekd$_{10}$kke | 17 | 14994 | 15009 | 2133 |
| | | | | | | 15400 | 15415 | |
| 548443 | n/a | n/a | GTTTCCTATAACAGTA | eekd$_{10}$kke | 12 | 14996 | 15011 | 2134 |
| | | | | | | 15402 | 15417 | |
| 548444 | n/a | n/a | CTATGTCACTGTACCT | eekd$_{10}$kke | 43 | 15038 | 15053 | 2135 |
| | | | | | | 15444 | 15459 | |
| 548445 | n/a | n/a | CCTATGTCACTGTACC | eekd$_{10}$kke | 62 | 15039 | 15054 | 2136 |
| | | | | | | 15445 | 15460 | |
| 548446 | n/a | n/a | TCCTATGTCACTGTAC | eekd$_{10}$kke | 16 | 15040 | 15055 | 2137 |
| | | | | | | 15446 | 15461 | |
| 548447 | n/a | n/a | CACTGTCCTATGTCAC | eekd$_{10}$kke | 59 | 15045 | 15060 | 2138 |
| | | | | | | 15451 | 15466 | |

TABLE 30-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 548448 | n/a | n/a | TCACTGTCCTATGTCA | eekd$_{10}$kke | 61 | 15046<br>15452 | 15061<br>15467 | 2139 |
| 548449 | n/a | n/a | ATCACTGTCCTATGTC | eekd$_{10}$kke | 62 | 15047<br>15453 | 15062<br>15468 | 2140 |
| 548450 | n/a | n/a | CTACCTATAACTCTAA | eekd$_{10}$kke | 0 | 15100 | 15115 | 2141 |
| 548451 | n/a | n/a | GTCCTATAACTATAAC | eekd$_{10}$kke | 0 | 15171<br>15577<br>15707<br>16006<br>16077<br>16102<br>16155 | 15186<br>15592<br>15722<br>16021<br>16092<br>16117<br>16170 | 2142 |
| 548452 | n/a | n/a | TATATCACTGTACCTA | eekd$_{10}$kke | 65 | 15252<br>15377<br>15515<br>15645<br>15847<br>15977 | 15267<br>15392<br>15530<br>15660<br>15862<br>15992 | 2143 |
| 548453 | n/a | n/a | TACCTATAACAGTATC | eekd$_{10}$kke | 12 | 15367 | 15382 | 2144 |
| 548454 | n/a | n/a | ACTGTACCTATAACAG | eekd$_{10}$kke | 17 | 15371 | 15386 | 2145 |
| 548455 | n/a | n/a | CACCGTACTAGTTTCC | eekd$_{10}$kke | 64 | 15757 | 15772 | 2146 |
| 548456 | n/a | n/a | TATAACAGTATCACCG | eekd$_{10}$kke | 52 | 15768 | 15783 | 2147 |
| 548457 | n/a | n/a | CTATAACAGTATCACC | eekd$_{10}$kke | 13 | 15769 | 15784 | 2148 |
| 548458 | n/a | n/a | ACCTATAACTATAACA | eekd$_{10}$kke | 0 | 15777<br>16249 | 15792<br>16264 | 2149 |

TABLE 31

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 531231 | n/a | n/a | TATCACTGTACTAGTTTCCT | eeeeed$_{10}$eeeee | 48 | 14744<br>14815<br>14886<br>14945<br>15005<br>15077<br>15220<br>15292<br>15351<br>15411<br>15483<br>15555<br>15613<br>15685<br>15815<br>15887<br>15945 | 14763<br>14834<br>14905<br>14964<br>15024<br>15096<br>15239<br>15311<br>15370<br>15430<br>15502<br>15574<br>15632<br>15704<br>15834<br>15906<br>15964 | 334 |
| 547747 | n/a | n/a | TCACTGTACTAGTTTC | eekd$_{10}$kke | 88 | 14746<br>14817<br>14888<br>14947<br>15007<br>15079<br>15222 | 14761<br>14832<br>14903<br>14962<br>15022<br>15094<br>15237 | 1267 |

TABLE 31-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| | | | | | | 15294 | 15309 | |
| | | | | | | 15353 | 15368 | |
| | | | | | | 15413 | 15428 | |
| | | | | | | 15485 | 15500 | |
| | | | | | | 15557 | 15572 | |
| | | | | | | 15615 | 15630 | |
| | | | | | | 15687 | 15702 | |
| | | | | | | 15817 | 15832 | |
| | | | | | | 15889 | 15904 | |
| | | | | | | 15947 | 15962 | |
| 548613 | n/a | n/a | TGGCGGGATCGGTGGT | eekd$_{10}$kke | 39 | 28510 | 28525 | 2150 |
| | | | | | | 28589 | 28604 | |
| 548614 | n/a | n/a | TGGTGGCGGGATCGGT | eekd$_{10}$kke | 0 | 28513 | 28528 | 2151 |
| | | | | | | 28592 | 28607 | |
| 548615 | n/a | n/a | TTGGTGGCGGGATCGG | eekd$_{10}$kke | 10 | 28514 | 28529 | 2152 |
| | | | | | | 28593 | 28608 | |
| 548616 | n/a | n/a | ATTGGTGGCGGGATCG | eekd$_{10}$kke | 35 | 28515 | 28530 | 2153 |
| 548617 | n/a | n/a | GATTGGTGGCGGGATC | eekd$_{10}$kke | 44 | 28516 | 28531 | 2154 |
| 548618 | n/a | n/a | GTTGGTGGCGGGATCG | eekd$_{10}$kke | 18 | 28594 | 28609 | 2155 |
| 548619 | n/a | n/a | GGTTGGTGGCGGGATC | eekd$_{10}$kke | 19 | 28595 | 28610 | 2156 |
| 548620 | n/a | n/a | TGGTTGGTGGCGGGAT | eekd$_{10}$kke | 24 | 28596 | 28611 | 2157 |
| 548621 | n/a | n/a | GAACACATCAGGGATT | eekd$_{10}$kke | 33 | 28638 | 28653 | 2158 |
| 548622 | n/a | n/a | TTTCTATGGGCCTGAC | eekd$_{10}$kke | 0 | 28669 | 28684 | 2159 |
| 548623 | n/a | n/a | GCTGTCACTTAAGCCA | eekd$_{10}$kke | 16 | 28862 | 28877 | 2160 |
| 548624 | n/a | n/a | TCTAGGGCCACACCTC | eekd$_{10}$kke | 24 | 28892 | 28907 | 2161 |
| 548625 | n/a | n/a | GTTCTACACACAGTAC | eekd$_{10}$kke | 0 | 29014 | 29029 | 2162 |
| 548626 | n/a | n/a | GCAGTATGTTCAATCC | eekd$_{10}$kke | 36 | 29202 | 29217 | 2163 |
| 548627 | n/a | n/a | CCCACATGTACCACCG | eekd$_{10}$kke | 22 | 29235 | 29250 | 2164 |
| 548628 | n/a | n/a | GTATGGCAGAGCCCCT | eekd$_{10}$kke | 9 | 29285 | 29300 | 2165 |
| 548629 | n/a | n/a | CCCATCTTGGGACTTT | eekd$_{10}$kke | 44 | 29341 | 29356 | 2166 |
| 548630 | n/a | n/a | TGGTCCCAAATTGGAG | eekd$_{10}$kke | 33 | 29387 | 29402 | 2167 |
| 548631 | n/a | n/a | CTCACAATACTGAGCC | eekd$_{10}$kke | 55 | 29421 | 29436 | 2168 |
| 548632 | n/a | n/a | GGAGATATCAGGTGCA | eekd$_{10}$kke | 45 | 29499 | 29514 | 2169 |
| 548633 | n/a | n/a | CAAGGCATGTGTGCAC | eekd$_{10}$kke | 41 | 29534 | 29549 | 2170 |
| 548634 | n/a | n/a | GCCTTATTCTGTGCAA | eekd$_{10}$kke | 0 | 29583 | 29598 | 2171 |
| 548635 | n/a | n/a | AGGTGTGGCGCGCGCC | eekd$_{10}$kke | 18 | 29853 | 29868 | 2172 |
| 548636 | n/a | n/a | CTCTATACAGCTGGGC | eekd$_{10}$kke | 5 | 30000 | 30015 | 2173 |
| 548637 | n/a | n/a | GCTGATCTTCTAATGC | eekd$_{10}$kke | 38 | 30063 | 30078 | 2174 |
| 548638 | n/a | n/a | CCTCATTGCTCCACTA | eekd$_{10}$kke | 26 | 30103 | 30118 | 2175 |
| 548639 | n/a | n/a | TGGGAAGAAACTAGCA | eekd$_{10}$kke | 10 | 30159 | 30174 | 2176 |
| 548640 | n/a | n/a | GAATGTTGCTGTCCCA | eekd$_{10}$kke | 32 | 30194 | 30209 | 2177 |
| 548641 | n/a | n/a | GCATCATGCTTACTGC | eekd$_{10}$kke | 23 | 30225 | 30240 | 2178 |
| 548642 | n/a | n/a | GCGGCAGTAGTGAATC | eekd$_{10}$kke | 23 | 30288 | 30303 | 2179 |

TABLE 31-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 548643 | n/a | n/a | CCTACCTAATTCCTCC | eekd$_{10}$kke | 0 | 30329 | 30344 | 2180 |
| 548644 | n/a | n/a | AACTGGGCAGTCCTTC | eekd$_{10}$kke | 14 | 30418 | 30433 | 2181 |
| 548645 | n/a | n/a | CCAGCGCAATTCTGCT | eekd$_{10}$kke | 8 | 30666 | 30681 | 2182 |
| 548646 | n/a | n/a | CGTTTCCCTCAACTCC | eekd$_{10}$kke | 24 | 30750 | 30765 | 2183 |
| 548647 | n/a | n/a | CACGGCAAGTCGCGGG | eekd$_{10}$kke | 39 | 30790 | 30805 | 2184 |
| 548648 | n/a | n/a | CAGTTGTATCCCTCCC | eekd$_{10}$kke | 32 | 30852 | 30867 | 2185 |
| 548649 | n/a | n/a | GCCTCTCAGACGGCAC | eekd$_{10}$kke | 0 | 30906 | 30921 | 2186 |
| 548650 | n/a | n/a | CTGATCCCACTTGCCC | eekd$_{10}$kke | 21 | 30991 | 31006 | 2187 |
| 548651 | n/a | n/a | AGTCTCTTTCCTACCC | eekd$_{10}$kke | 61 | 31030 | 31045 | 2188 |
| 548652 | n/a | n/a | CCACGATGCTCTGGCC | eekd$_{10}$kke | 65 | 31068 | 31083 | 2189 |
| 548653 | n/a | n/a | TCGGCTCCTGGCAGCA | eekd$_{10}$kke | 46 | 31111 | 31126 | 2190 |
| 548654 | n/a | n/a | ACCATTCCTGACCATG | eekd$_{10}$kke | 34 | 31151 | 31166 | 2191 |
| 548655 | n/a | n/a | CCCGAGGTCACATAAT | eekd$_{10}$kke | 56 | 31416 | 31431 | 2192 |
| 548656 | n/a | n/a | TTACAACAGACCCAGG | eekd$_{10}$kke | 35 | 31497 | 31512 | 2193 |
| 548657 | n/a | n/a | AGCAGGGTATCTTCAC | eekd$_{10}$kke | 26 | 31548 | 31563 | 2194 |
| 548658 | n/a | n/a | GAAGTTCCTGTGTCTT | eekd$_{10}$kke | 11 | 31593 | 31608 | 2195 |
| 548659 | n/a | n/a | CCAACCTCTAAGGCTA | eekd$_{10}$kke | 17 | 31721 | 31736 | 2196 |
| 548660 | n/a | n/a | ATGCTTACCTTTCTCC | eekd$_{10}$kke | 0 | 31955 | 31970 | 2197 |
| 548661 | n/a | n/a | ACGACCCACTCCATGT | eekd$_{10}$kke | 18 | 32016 | 32031 | 2198 |
| 548662 | n/a | n/a | TGCTTAAAAGTCTCCC | eekd$_{10}$kke | 5 | 32155 | 32170 | 2199 |
| 548663 | n/a | n/a | GCCCTAGAAGGGCCCA | eekd$_{10}$kke | 20 | 32219 | 32234 | 2200 |
| 548664 | n/a | n/a | GCGGGTGGTCTTGCAC | eekd$_{10}$kke | 38 | 32245 | 32260 | 2201 |
| 548665 | n/a | n/a | GCTCCCGGCCATTAGC | eekd$_{10}$kke | 8 | 32312 | 32327 | 2202 |
| 548666 | n/a | n/a | TCTCCATAGTGAGACG | eekd$_{10}$kke | 1 | 32342 | 32357 | 2203 |
| 548667 | n/a | n/a | TGGCAAGCTACCTTCT | eekd$_{10}$kke | 51 | 32384 | 32399 | 2204 |
| 548668 | n/a | n/a | GGGAGCTTTCATGGCT | eekd$_{10}$kke | 68 | 32506 | 32521 | 2205 |
| 548669 | n/a | n/a | AATGCAGGCCAGCATC | eekd$_{10}$kke | 42 | 32541 | 32556 | 2206 |
| 548670 | n/a | n/a | GAAAAGCCCTCCGAGC | eekd$_{10}$kke | 15 | 32590 | 32605 | 2207 |
| 548671 | n/a | n/a | CAACAATCCAAAGCCT | eekd$_{10}$kke | 3 | 32674 | 32689 | 2208 |
| 548672 | n/a | n/a | CCCCCCAGAAATCCCA | eekd$_{10}$kke | 40 | 32708 | 32723 | 2209 |
| 548673 | n/a | n/a | GACCTTGCTTCCATGT | eekd$_{10}$kke | 40 | 32753 | 32768 | 2210 |
| 548674 | n/a | n/a | GAGAGACGGCACCCTG | eekd$_{10}$kke | 4 | 32829 | 32844 | 2211 |
| 548675 | n/a | n/a | GGGAAGGTAGTGTTAC | eekd$_{10}$kke | 8 | 32898 | 32913 | 2212 |
| 548676 | n/a | n/a | GTGAATCAGAGCAGTG | eekd$_{10}$kke | 63 | 32963 | 32978 | 2213 |
| 548677 | n/a | n/a | TCACCTGTGAGTAACC | eekd$_{10}$kke | 40 | 33089 | 33104 | 2214 |
| 548678 | n/a | n/a | GAGTTACCTTACAAGC | eekd$_{10}$kke | 22 | 33232 | 33247 | 2215 |

TABLE 31-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 548679 | n/a | n/a | TCTCAAGCAGCCTATT | eekd$_{10}$kke | 0 | 33267 | 33282 | 2216 |
| 548680 | n/a | n/a | GCCCCTCTTAAATAGC | eekd$_{10}$kke | 9 | 33446 | 33461 | 2217 |
| 548681 | n/a | n/a | GATATCATCATCCCAA | eekd$_{10}$kke | 22 | 33513 | 33528 | 2218 |
| 548682 | n/a | n/a | GTATCCCCTTTTCTAT | eekd$_{10}$kke | 0 | 33556 | 33571 | 2219 |
| 548683 | n/a | n/a | AGTATCTCATGTGCCT | eekd$_{10}$kke | 46 | 33581 | 33596 | 2220 |
| 548684 | n/a | n/a | CAAGACCTTGCTTGCC | eekd$_{10}$kke | 24 | 33658 | 33673 | 2221 |
| 548685 | n/a | n/a | TAGTCCACTACACAGC | eekd$_{10}$kke | 24 | 33802 | 33817 | 2222 |
| 548686 | n/a | n/a | ACGACAATGGGATTCA | eekd$_{10}$kke | 0 | 33844 | 33859 | 2223 |
| 548687 | n/a | n/a | GAATCTCCCTGAGTCA | eekd$_{10}$kke | 20 | 33888 | 33903 | 2224 |
| 548688 | n/a | n/a | TAGAGGGATCCCAGGA | eekd$_{10}$kke | 0 | 34416 | 34431 | 2225 |
| 548689 | n/a | n/a | CCAGGTGCAGCACGGA | eekd$_{10}$kke | 12 | 34483 | 34498 | 2226 |

Example 4: Dose-Dependent Antisense Inhibition of Human PKK in HepaRG™ Cells

Gapmers from the studies described above exhibiting significant in vitro inhibition of PKK mRNA were selected and tested at various doses in HepaRG™ cells. Cells were plated at a density of 20,000 cells per well and transfected using electroporation with 0.12 µM, 0.37 µM, 1.11 µM, 3.33 µM, and 10.00 µM concentrations of antisense oligonucleotide. After a treatment period of approximately 16 hours, RNA was isolated from the cells and PKK mRNA levels were measured by quantitative real-time PCR. Human PKK primer probe set RTS3454 was used to measure mRNA levels. PKK mRNA levels were adjusted according to total RNA content, as measured by RIBOGREEN®. The antisense oligonucleotides were tested in a series of experiments that had similar culture conditions. The results for each experiment are presented in separate tables shown below. Results are presented as percent inhibition of PKK, relative to untreated control cells.

The half maximal inhibitory concentration (IC$_{50}$) of each oligonucleotide is also presented. PKK mRNA levels were significantly reduced in a dose-dependent manner in antisense oligonucleotide treated cells.

TABLE 32

| ISIS No | 0.12 µM | 0.37 µM | 1.11 µM | 3.33 µM | 10.00 µM | IC$_{50}$ (µM) |
|---|---|---|---|---|---|---|
| 486847 | 0 | 34 | 48 | 71 | 87 | 1.1 |
| 530933 | 15 | 13 | 42 | 67 | 66 | 1.7 |
| 530959 | 12 | 27 | 53 | 80 | 94 | 0.9 |
| 530965 | 8 | 5 | 63 | 83 | 91 | 0.8 |
| 530967 | 30 | 36 | 48 | 82 | 91 | 0.7 |
| 530970 | 1 | 0 | 66 | 76 | 84 | 1.0 |
| 530971 | 12 | 40 | 52 | 66 | 70 | 1.3 |
| 530988 | 0 | 25 | 54 | 86 | 78 | 0.9 |
| 530992 | 0 | 50 | 63 | 83 | 80 | 0.7 |
| 531002 | 6 | 28 | 58 | 82 | 86 | 0.9 |
| 531004 | 0 | 14 | 25 | 71 | 84 | 2.1 |
| 531005 | 14 | 28 | 61 | 73 | 77 | 0.9 |

TABLE 32-continued

| ISIS No | 0.12 µM | 0.37 µM | 1.11 µM | 3.33 µM | 10.00 µM | IC$_{50}$ (µM) |
|---|---|---|---|---|---|---|
| 531022 | 0 | 0 | 32 | 62 | 77 | 2.2 |
| 531078 | 10 | 27 | 54 | 69 | 92 | 1.1 |
| 531231 | 23 | 30 | 76 | 89 | 94 | 0.6 |

TABLE 33

| ISIS No | 0.12 µM | 0.37 µM | 1.11 µM | 3.33 µM | 10.00 µM | IC$_{50}$ (µM) |
|---|---|---|---|---|---|---|
| 531026 | 23 | 26 | 49 | 75 | 85 | 1.0 |
| 531055 | 3 | 28 | 64 | 76 | 81 | 0.9 |
| 531069 | 19 | 39 | 48 | 76 | 83 | 0.9 |
| 531071 | 23 | 37 | 56 | 83 | 83 | 0.7 |
| 531110 | 14 | 29 | 49 | 76 | 85 | 1.1 |
| 531121 | 0 | 13 | 47 | 69 | 79 | 1.5 |
| 531123 | 14 | 43 | 51 | 71 | 64 | 0.9 |
| 531172 | 0 | 16 | 37 | 60 | 60 | 2.1 |
| 531198 | 0 | 35 | 62 | 76 | 60 | 0.8 |
| 531231 | 18 | 0 | 36 | 76 | 84 | 2.0 |
| 531232 | 15 | 26 | 40 | 62 | 76 | 1.7 |
| 531233 | 17 | 27 | 50 | 77 | 84 | 1.0 |
| 531234 | 24 | 21 | 47 | 72 | 82 | 1.4 |
| 531235 | 27 | 55 | 62 | 84 | 95 | 0.4 |
| 531236 | 4 | 28 | 59 | 85 | 93 | 0.8 |

Example 5: Dose-Dependent Antisense Inhibition of Human PKK in HepaRG™ Cells

Gapmers from the studies described above exhibiting significant in vitro inhibition of PKK mRNA were selected and tested at various doses in HepaRG™ cells. Cells were plated at a density of 20,000 cells per well and transfected using electroporation with 0.19 µM, 0.56 µM, 1.67 µM, and 5.00 µM concentrations of antisense oligonucleotide. After a treatment period of approximately 16 hours, RNA was isolated from the cells and PKK mRNA levels were measured by quantitative real-time PCR. Human PKK primer probe set RTS3454 was used to measure mRNA levels. PKK mRNA levels were adjusted according to total RNA content, as measured by RIBOGREEN®. The antisense oligonucleotides were tested in a series of experiments that had similar culture conditions. The results for each experiment are presented in separate tables shown below. Results are presented as percent inhibition of PKK, relative to untreated control cells. 'n/a' indicates that there was no measurement done for that particular antisense oligonucleotide for that particular dose.

The half maximal inhibitory concentration ($IC_{50}$) of each oligonucleotide is also presented. PKK mRNA levels were significantly reduced in a dose-dependent manner in antisense oligonucleotide treated cells.

TABLE 34

| ISIS No | 0.19 μM | 0.56 μM | 1.67 μM | 5.00 μM | $IC_{50}$ (μM) |
|---|---|---|---|---|---|
| 531231 | 32 | 30 | 73 | 89 | 0.5 |
| 546158 | 5 | 45 | 79 | 83 | 0.7 |
| 546188 | 36 | 55 | 81 | 83 | 0.4 |
| 546253 | 1 | 13 | 46 | 81 | 1.7 |
| 546254 | 51 | 66 | 80 | 91 | 0.2 |
| 546343 | 28 | 64 | 87 | 87 | 0.4 |
| 546825 | 46 | 73 | 86 | 88 | 0.2 |
| 546827 | 32 | 70 | 84 | 90 | 0.3 |
| 546828 | 39 | 58 | 87 | 93 | 0.3 |
| 546829 | 3 | 30 | 73 | 88 | 1.0 |
| 546846 | 36 | 45 | 71 | 82 | 0.5 |
| 547413 | 0 | 0 | 41 | 83 | 2.2 |
| 547423 | 37 | 50 | 92 | 90 | 0.4 |
| 547445 | 41 | 75 | 82 | 88 | 0.2 |
| 547456 | 12 | 67 | 66 | 80 | 1.0 |
| 547464 | 21 | 52 | 67 | 97 | 0.6 |
| 547564 | 51 | 48 | 82 | 90 | 0.2 |
| 547587 | 20 | 62 | 84 | 86 | 0.5 |
| 548758 | 41 | 47 | 82 | 94 | 0.4 |

TABLE 35

| ISIS No | 0.19 μM | 0.56 μM | 1.67 μM | 5.00 μM | $IC_{50}$ (μM) |
|---|---|---|---|---|---|
| 531231 | 25 | 34 | 84 | 92 | 0.7 |
| 546190 | 33 | 65 | 86 | n/a | 0.4 |
| 546208 | 16 | 45 | 79 | 91 | 0.7 |
| 546216 | 62 | 69 | 88 | 88 | 0.1 |
| 546255 | 32 | 35 | 78 | 87 | 0.5 |
| 546268 | 56 | 50 | 82 | 93 | 0.1 |
| 546301 | 25 | 50 | 53 | 87 | 0.8 |
| 546849 | 23 | 35 | 83 | 91 | 0.7 |
| 546852 | 19 | 40 | 78 | 85 | 0.8 |
| 546889 | 23 | 54 | 78 | 91 | 0.6 |
| 546916 | 43 | 71 | 79 | 89 | 0.2 |
| 546967 | 20 | 39 | 76 | 71 | 0.7 |
| 547273 | 44 | 69 | 87 | 87 | 0.2 |
| 547276 | 35 | 44 | 71 | 77 | 0.6 |
| 547335 | 8 | 52 | 85 | 92 | 0.7 |
| 547340 | 46 | 79 | 88 | n/a | 0.2 |
| 547602 | 18 | 53 | 92 | 87 | 0.5 |
| 547647 | 1 | 70 | 72 | n/a | 0.8 |
| 547694 | 0 | 29 | 67 | 90 | 1.2 |

TABLE 36

| ISIS No | 0.19 μM | 0.56 μM | 1.67 μM | 5.00 μM | $IC_{50}$ (μM) |
|---|---|---|---|---|---|
| 531231 | 58 | 64 | 77 | 98 | 0.1 |
| 546247 | 0 | 29 | 71 | 88 | 1.1 |
| 546251 | 31 | 60 | 99 | 89 | 0.5 |
| 546753 | 28 | 47 | 83 | 96 | 0.5 |
| 546826 | 17 | 40 | 87 | 97 | 0.7 |

TABLE 36-continued

| ISIS No | 0.19 μM | 0.56 μM | 1.67 μM | 5.00 μM | $IC_{50}$ (μM) |
|---|---|---|---|---|---|
| 546833 | 8 | 33 | 74 | 94 | 0.9 |
| 546854 | 23 | 39 | 83 | 94 | 0.6 |
| 546894 | 15 | 47 | 50 | 93 | 0.9 |
| 546897 | 40 | 56 | 71 | 95 | 0.4 |
| 546903 | 15 | 37 | 74 | 98 | 0.8 |
| 546986 | 31 | 49 | 77 | 89 | 0.5 |
| 547293 | 53 | 57 | 80 | 86 | 0.2 |
| 547298 | 32 | 61 | 74 | 90 | 0.4 |
| 547364 | 38 | 47 | 54 | 89 | 0.6 |
| 547373 | 20 | 7 | 49 | 86 | 1.1 |
| 547426 | 19 | 50 | 84 | 93 | 0.6 |
| 547454 | 19 | 40 | 58 | 92 | 0.9 |
| 547617 | 52 | 66 | 77 | 93 | 0.2 |
| 548770 | 26 | 54 | 77 | 91 | 0.5 |

TABLE 37

| ISIS No | 0.19 μM | 0.56 μM | 1.67 μM | 5.00 μM | $IC_{50}$ (μM) |
|---|---|---|---|---|---|
| 531231 | 34 | 47 | 72 | n/a | 0.5 |
| 546214 | 0 | 0 | 68 | 85 | 1.3 |
| 546304 | 0 | 6 | 51 | 71 | 2.1 |
| 546739 | 35 | 55 | 57 | 79 | 0.6 |
| 546832 | 19 | 38 | 70 | 95 | 0.8 |
| 546847 | 39 | 57 | 75 | 89 | 0.4 |
| 546855 | 18 | 7 | 30 | 82 | 2.2 |
| 546877 | 0 | 19 | 75 | 80 | 1.3 |
| 546939 | 1 | 66 | 86 | 90 | 0.6 |
| 547349 | 0 | 8 | 66 | 76 | 1.6 |
| 547360 | 8 | 27 | 76 | 76 | 0.8 |
| 547368 | 0 | 0 | 31 | 80 | 2.5 |
| 547483 | 0 | 9 | 49 | 71 | 2.1 |
| 547575 | 0 | 34 | 82 | 93 | 1.1 |
| 547618 | 0 | 0 | 73 | 98 | 1.3 |
| 547622 | 0 | 47 | 79 | 90 | 0.9 |
| 547637 | 10 | 21 | 36 | 82 | 1.8 |
| 547731 | 0 | 0 | 17 | 56 | 5.0 |
| 548752 | 0 | 0 | 51 | 90 | 1.9 |

TABLE 38

| ISIS No | 0.19 μM | 0.56 μM | 1.67 μM | 5.00 μM | $IC_{50}$ (μM) |
|---|---|---|---|---|---|
| 531231 | 21 | 45 | 67 | 96 | 0.7 |
| 546195 | 34 | 51 | 79 | 92 | 0.5 |
| 546198 | 7 | 3 | 45 | 92 | 1.3 |
| 546287 | 0 | 15 | 39 | 89 | 1.7 |
| 546358 | 0 | 19 | 71 | 80 | 1.3 |
| 546403 | 0 | 20 | 37 | 41 | >5.0 |
| 546410 | 13 | 43 | 52 | 75 | 1.2 |
| 546412 | 0 | 1 | 61 | 62 | 2.3 |
| 546429 | 6 | 10 | 44 | 69 | 2.3 |
| 546834 | 1 | 0 | 30 | 83 | 2.3 |
| 547006 | 0 | 0 | 54 | 77 | 1.5 |
| 547294 | 28 | 59 | 87 | 86 | 0.4 |
| 547337 | 23 | 41 | 55 | 79 | 1.0 |
| 547514 | 18 | 8 | 51 | 80 | 1.9 |
| 547584 | 26 | 34 | 76 | 86 | 0.7 |
| 547585 | 42 | 57 | 70 | 95 | 0.4 |
| 547615 | 20 | 26 | 41 | 84 | 1.4 |
| 547636 | 0 | 24 | 79 | 94 | 1.1 |
| 548744 | 14 | 35 | 63 | 83 | 1.0 |

TABLE 39

| ISIS No | 0.19 µM | 0.56 µM | 1.67 µM | 5.00 µM | IC$_{50}$ (µM) |
|---|---|---|---|---|---|
| 531231 | 21 | 39 | 90 | 97 | 0.6 |
| 546232 | 49 | 50 | 94 | 97 | 0.2 |
| 546248 | 25 | 66 | 87 | 93 | 0.4 |
| 546835 | 9 | 35 | 68 | 93 | 0.9 |
| 546848 | 0 | 18 | 91 | 97 | 1.0 |
| 546853 | 47 | 64 | 84 | n/a | 0.2 |
| 546870 | 35 | 42 | 80 | 95 | 0.5 |
| 546872 | 32 | 33 | 82 | 94 | 0.4 |
| 546876 | 0 | 50 | 85 | 95 | 0.8 |
| 547275 | 34 | 66 | 82 | 95 | 0.3 |
| 547341 | 36 | 58 | 91 | 95 | 0.3 |
| 547366 | 0 | 45 | 68 | 91 | 1.2 |
| 547453 | 25 | 40 | 54 | 92 | 0.8 |
| 547457 | 41 | 65 | 80 | 85 | 0.3 |
| 547616 | 26 | 50 | 72 | 89 | 0.6 |
| 547632 | 44 | 47 | 81 | 97 | 0.6 |
| 547633 | 12 | 46 | 78 | n/a | 0.7 |
| 547718 | 36 | 12 | 69 | 74 | 1.6 |
| 548757 | 18 | 49 | 82 | 93 | 0.6 |

TABLE 40

| ISIS No | 0.19 µM | 0.56 µM | 1.67 µM | 5.00 µM | IC$_{50}$ (µM) |
|---|---|---|---|---|---|
| 531231 | 6 | 38 | 74 | 95 | 0.8 |
| 546291 | 22 | 32 | 34 | 72 | 2.0 |
| 546310 | 0 | 36 | 56 | 80 | 1.3 |
| 546896 | 0 | 45 | 82 | 97 | 0.8 |
| 546980 | 0 | 18 | 29 | 80 | 2.2 |
| 547009 | 0 | 9 | 21 | 63 | 3.6 |
| 547019 | 0 | 6 | 54 | 86 | 1.6 |
| 547277 | 2 | 32 | 34 | 62 | 2.8 |
| 547288 | 0 | 0 | 0 | 38 | >5.0 |
| 547374 | 0 | 15 | 24 | 44 | >5.0 |
| 547493 | 0 | 26 | 64 | 77 | 1.3 |
| 547520 | 0 | 25 | 66 | 64 | 1.1 |
| 547712 | 0 | 5 | 21 | 62 | 3.8 |
| 547722 | 0 | 15 | 32 | 73 | 2.4 |
| 547728 | 0 | 2 | 16 | 61 | 4.4 |
| 547780 | 0 | 10 | 36 | 55 | 3.9 |
| 548743 | 25 | 57 | 73 | 88 | 0.5 |
| 548753 | 0 | 23 | 49 | 84 | 1.5 |
| 548756 | 0 | 4 | 16 | 86 | >5.0 |

TABLE 41

| ISIS No | 0.19 µM | 0.56 µM | 1.67 µM | 5.00 µM | IC$_{50}$ (µM) |
|---|---|---|---|---|---|
| 531231 | 25 | 55 | 89 | 97 | 0.5 |
| 546188 | 27 | 69 | 88 | 97 | 0.4 |
| 546216 | 23 | 78 | 95 | 98 | <0.2 |
| 546254 | 40 | 63 | 84 | 95 | 0.3 |
| 546268 | 0 | 71 | 92 | 92 | 0.5 |
| 546343 | 37 | 32 | 83 | 95 | 0.4 |
| 546825 | 38 | 82 | n/a | 99 | 0.2 |
| 546827 | 23 | 74 | 98 | 96 | 0.4 |
| 546828 | 0 | 64 | 89 | 97 | 0.2 |
| 546846 | 26 | 49 | 85 | n/a | 0.5 |
| 546967 | 22 | 45 | 74 | 92 | 0.7 |
| 547273 | 0 | 60 | 82 | 83 | 0.6 |
| 547340 | 34 | 84 | 96 | n/a | 0.3 |
| 547423 | 78 | 92 | n/a | n/a | <0.2 |
| 547445 | 80 | 87 | 98 | 91 | <0.2 |
| 547564 | 46 | 66 | 90 | 97 | 0.2 |
| 547587 | 38 | 64 | 91 | 97 | 0.3 |
| 547602 | 1 | 9 | 52 | 93 | 1.4 |
| 548758 | 0 | 72 | 79 | n/a | 0.6 |

TABLE 42

| ISIS No | 0.19 µM | 0.56 µM | 1.67 µM | 5.00 µM | IC$_{50}$ (µM) |
|---|---|---|---|---|---|
| 531231 | 7 | 39 | 56 | 97 | 1.0 |
| 546190 | 21 | 34 | 76 | 98 | 0.7 |
| 546208 | 5 | 33 | 70 | 97 | 0.9 |
| 546251 | 19 | 45 | 91 | 97 | 0.6 |
| 546255 | 5 | 39 | 82 | 96 | 0.8 |
| 546739 | 4 | 62 | 84 | 86 | 0.6 |
| 546753 | 17 | 31 | 70 | 91 | 0.9 |
| 546849 | 13 | 45 | 84 | 98 | 0.7 |
| 546889 | 25 | 9 | 73 | 92 | 1.4 |
| 546897 | 16 | 17 | 69 | 97 | 0.8 |
| 546916 | 0 | 27 | 73 | 97 | 1.0 |
| 546986 | 7 | 28 | 69 | 86 | 1.1 |
| 547276 | 6 | 3 | 53 | 68 | 2.2 |
| 547293 | 0 | 45 | 65 | 70 | 1.3 |
| 547298 | 0 | 12 | 67 | 87 | 1.7 |
| 547335 | 0 | 13 | 73 | 95 | 1.3 |
| 547426 | 18 | 35 | 80 | 95 | 0.7 |
| 547617 | 17 | 37 | 79 | 98 | 0.7 |
| 548770 | 9 | 0 | 61 | 92 | 1.7 |

TABLE 43

| ISIS No | 0.19 µM | 0.56 µM | 1.67 µM | 5.00 µM | IC$_{50}$ (µM) |
|---|---|---|---|---|---|
| 531231 | 6 | 56 | 68 | 97 | 0.8 |
| 546195 | 0 | 27 | 91 | 94 | 0.9 |
| 546232 | 0 | 74 | 95 | 96 | 0.2 |
| 546248 | 0 | 59 | 73 | 89 | 0.8 |
| 546832 | 36 | 49 | 85 | 97 | 0.4 |
| 546847 | 14 | 44 | 83 | 95 | 0.7 |
| 546853 | 4 | 49 | 74 | 92 | 0.8 |
| 546870 | 36 | 34 | 61 | 91 | 1.0 |
| 546872 | 42 | 13 | 59 | 99 | 1.4 |
| 546896 | 35 | 60 | 83 | n/a | 0.4 |
| 546939 | 16 | 71 | 96 | 95 | 0.4 |
| 547275 | 56 | 16 | 80 | 86 | 1.2 |
| 547294 | 4 | 70 | 84 | 91 | 0.6 |
| 547341 | 45 | 44 | 81 | 95 | 0.6 |
| 547457 | 33 | 42 | 70 | 83 | 0.6 |
| 547584 | 0 | 21 | 64 | 92 | 1.3 |
| 547585 | 0 | 46 | 89 | 93 | 0.8 |
| 547632 | 0 | 0 | 63 | 91 | 1.6 |
| 548743 | 22 | 47 | 74 | 96 | 0.6 |

Example 6: Dose-Dependent Antisense Inhibition of Human PKK in HepaRG™ Cells

Gapmers from the studies described above exhibiting significant in vitro inhibition of PKK mRNA were selected and tested at various doses in HepaRG™ cells. Cells were plated at a density of 20,000 cells per well and transfected using electroporation with 0.11 µM, 0.33 µM, 1.00 µM, and 3.00 µM concentrations of antisense oligonucleotide. After a treatment period of approximately 16 hours, RNA was isolated from the cells and PKK mRNA levels were measured by quantitative real-time PCR. Human PKK primer probe set RTS3454 was used to measure mRNA levels. PKK mRNA levels were adjusted according to total RNA content, as measured by RIBOGREEN®. The antisense oligonucleotides were tested in a series of experiments that had similar culture conditions. The results for each experiment are presented in separate tables shown below. Results are presented as percent inhibition of PKK, relative to untreated control cells. 'n/a' indicates that there was no measurement done for that particular antisense oligonucleotide for that particular dose.

The half maximal inhibitory concentration (IC$_{50}$) of each oligonucleotide is also presented. PKK mRNA levels were significantly reduced in a dose-dependent manner in antisense oligonucleotide treated cells.

TABLE 44

| ISIS No | 0.11 µM | 0.33 µM | 1.00 µM | 3.00 µM | IC$_{50}$ (µM) |
|---|---|---|---|---|---|
| 547747 | 24 | 29 | 81 | 89 | 0.4 |
| 547769 | 12 | 17 | 80 | 96 | 0.6 |
| 547824 | 45 | 73 | 78 | n/a | 0.1 |
| 547835 | 44 | 27 | 53 | 79 | 0.9 |
| 547843 | 0 | 52 | 80 | 91 | 0.4 |
| 547857 | 36 | 66 | 77 | 93 | 0.2 |
| 547870 | 0 | 44 | 80 | 97 | 0.6 |
| 547943 | 33 | 70 | 87 | 90 | 0.2 |
| 547946 | 0 | 47 | 74 | n/a | 0.5 |
| 547947 | 24 | 58 | 81 | 93 | 0.3 |
| 547998 | 55 | 73 | 91 | 91 | 0.1 |
| 548004 | 24 | 47 | 80 | 92 | 0.3 |
| 548010 | 0 | 11 | 49 | 64 | 1.4 |
| 548047 | 50 | 62 | 76 | 95 | 0.1 |
| 548147 | 59 | 94 | 80 | n/a | 0.0 |
| 548338 | 41 | 58 | 79 | 95 | 0.2 |
| 548348 | 19 | 46 | 67 | 91 | 0.4 |
| 548409 | 21 | 60 | 90 | 93 | 0.3 |
| 548557 | 5 | 47 | 82 | 95 | 0.4 |

TABLE 45

| ISIS No | 0.11 µM | 0.33 µM | 1.00 µM | 3.00 µM | IC$_{50}$ (µM) |
|---|---|---|---|---|---|
| 547747 | 8 | 61 | 90 | 92 | 0.3 |
| 547807 | 26 | 71 | 61 | 94 | 0.4 |
| 547922 | 67 | 75 | 81 | 92 | 0.0 |
| 547927 | 56 | 64 | 92 | 88 | 0.1 |
| 547948 | 60 | 80 | 88 | 97 | 0.0 |
| 547979 | 56 | 58 | 94 | 97 | 0.1 |
| 548005 | 53 | 49 | 71 | 95 | 0.4 |
| 548024 | 28 | 57 | 84 | 82 | 0.3 |
| 548043 | 14 | 60 | 90 | 92 | 0.3 |
| 548055 | 43 | 57 | 50 | 88 | 0.3 |
| 548106 | 53 | 54 | 82 | 94 | 0.1 |
| 548109 | 50 | 92 | 79 | 85 | 0.1 |
| 548155 | 49 | 50 | 70 | 81 | 0.3 |
| 548180 | 11 | 59 | 71 | 88 | 0.4 |
| 548278 | 3 | 59 | 78 | 93 | 0.4 |
| 548343 | 61 | 67 | 88 | 92 | 0.0 |
| 548558 | 53 | 61 | 78 | 95 | 0.1 |
| 548570 | 20 | 40 | 70 | 94 | 0.4 |
| 548583 | 43 | 46 | 93 | 88 | 0.2 |

TABLE 46

| ISIS No | 0.11 µM | 0.33 µM | 1.00 µM | 3.00 µM | IC$_{50}$ (µM) |
|---|---|---|---|---|---|
| 547747 | 3 | 44 | 72 | 90 | 0.5 |
| 547849 | 36 | 52 | 67 | n/a | 0.3 |
| 547851 | 16 | 46 | 83 | n/a | 0.4 |
| 547859 | 29 | 56 | 83 | 78 | 0.3 |
| 547862 | 26 | 71 | 69 | n/a | 0.3 |
| 547877 | 29 | 66 | 83 | n/a | 0.2 |
| 547942 | 25 | 51 | 91 | n/a | 0.3 |
| 547997 | 39 | 68 | n/a | 82 | 0.2 |
| 548046 | 7 | 35 | 64 | 77 | 0.7 |
| 548048 | 49 | 66 | 86 | 92 | 0.1 |
| 548061 | 26 | 61 | 59 | n/a | 0.4 |

TABLE 46-continued

| ISIS No | 0.11 µM | 0.33 µM | 1.00 µM | 3.00 µM | IC$_{50}$ (µM) |
|---|---|---|---|---|---|
| 548070 | 26 | 35 | 48 | 63 | 1.1 |
| 548125 | 33 | 50 | 81 | 73 | 0.3 |
| 548195 | 5 | 23 | 61 | 76 | 0.8 |
| 548265 | 47 | 69 | 78 | 67 | 0.1 |
| 548410 | 31 | 58 | 85 | 82 | 0.2 |
| 548424 | 17 | 67 | 86 | 72 | 0.3 |
| 548425 | 41 | 57 | 68 | 80 | 0.2 |
| 548547 | 30 | 41 | 76 | 90 | 0.4 |

TABLE 47

| ISIS No | 0.11 µM | 0.33 µM | 1.00 µM | 3.00 µM | IC$_{50}$ (µM) |
|---|---|---|---|---|---|
| 547747 | 16 | 59 | 85 | 96 | 0.3 |
| 547808 | 19 | 22 | 48 | 71 | 1.1 |
| 547861 | 7 | 40 | 75 | 84 | 0.5 |
| 548069 | 6 | 0 | 27 | 66 | 1.9 |
| 548128 | 14 | 29 | 49 | 66 | 1.1 |
| 548170 | 0 | 8 | 26 | 65 | 2.0 |
| 548174 | 20 | 18 | 29 | 62 | 2.0 |
| 548197 | 33 | 37 | 51 | 75 | 0.8 |
| 548201 | 0 | 7 | 70 | 85 | 0.8 |
| 548217 | 22 | 24 | 54 | 71 | 0.9 |
| 548220 | 0 | 0 | 0 | 6 | >3 |
| 548247 | 16 | 50 | 62 | 82 | 0.5 |
| 548422 | 0 | 32 | 71 | 93 | 0.7 |
| 548479 | 2 | 52 | 82 | 97 | 0.4 |
| 548486 | 20 | 48 | 77 | 92 | 0.4 |
| 548521 | 21 | 0 | 3 | 1 | >3 |
| 548655 | 0 | 0 | 8 | 33 | >3 |
| 548667 | 0 | 37 | 73 | 86 | 0.7 |
| 548668 | 10 | 30 | 61 | 84 | 0.7 |

Example 7: Efficacy of Antisense Oligonucleotides Targeting Human PKK in Transgenic Mice Transgenic mice containing a 37,390 base pair fragment of the human KLKB1 gene sequence (chromosome 4: position 187148672-187179625, accession no: NC_000004.11) were treated with ISIS antisense oligonucleotides selected from studies described above, which were evaluated for efficacy in this model.

Treatment

Groups of transgenic mice were injected subcutaneously twice a week for 3 weeks with 2.5 mg/kg/week, 5.0 mg/kg/week, 10 mg/kg/week or 20 mg/kg/week of ISIS 546232, ISIS 546251, ISIS 546254, ISIS 546343, ISIS 546828, ISIS 547455, ISIS 547457, ISIS 547927, and ISIS 548048. One group of transgenic mice was injected subcutaneously twice a week for 3 weeks with PBS. Mice were euthanized 48 hours after the last dose, and organs and plasma were harvested for further analysis.

RNA Analysis

To evaluate the effect of ISIS oligonucleotides on target reduction, RNA was extracted from liver tissue for real-time PCR analysis of human PKK. Results are presented as percent inhibition of PKK mRNA, relative to PBS control. As shown in Table 48, treatment with ISIS antisense oligonucleotides resulted in significant reduction of PKK mRNA in comparison to the PBS control.

TABLE 48

Percent Inhibition of PKK mRNA in the transgenic mice liver relative to the PBS control

| ISIS No | Dose | % inhibition |
|---|---|---|
| 547927 | 20 | 71 |
|  | 10 | 93 |
|  | 5 | 52 |
|  | 2.5 | 35 |
| 547455 | 20 | 62 |
|  | 10 | 45 |
|  | 5 | 69 |
|  | 2.5 | 0 |
| 546232 | 20 | 84 |
|  | 10 | 30 |
|  | 5 | 53 |
|  | 2.5 | 57 |
| 546254 | 20 | 83 |
|  | 10 | 84 |
|  | 5 | 55 |
|  | 2.5 | 31 |
| 546343 | 20 | 86 |
|  | 10 | 66 |
|  | 5 | n/a |
|  | 2.5 | 46 |
| 548048 | 20 | 80 |
|  | 10 | 72 |
|  | 5 | 77 |
|  | 2.5 | 7 |
| 546828 | 20 | 83 |
|  | 10 | 32 |
|  | 5 | 62 |
|  | 2.5 | 77 |
| 546251 | 20 | 79 |
|  | 10 | 66 |
|  | 5 | 51 |
|  | 2.5 | 13 |
| 547457 | 20 | 62 |
|  | 10 | 45 |
|  | 5 | 69 |
|  | 2.5 | 0 |

Protein Analysis

Plasma PKK protein levels were evaluated in all groups. Results are presented as percent inhibition of PKK protein, relative to PBS control. As shown in Table 49, treatment with ISIS antisense oligonucleotides resulted in significant reduction of PKK protein levels in comparison to the PBS control.

TABLE 49

Percent reduction of PKK protein levels in the transgenic mice relative to the PBS control

| ISIS No | Dose | % inhibition |
|---|---|---|
| 547927 | 20 | 80 |
|  | 10 | n/a |
|  | 5 | 21 |
|  | 2.5 | 25 |
| 547455 | 20 | 78 |
|  | 10 | 32 |
|  | 5 | 0 |
|  | 2.5 | 0 |
| 546232 | 20 | 79 |
|  | 10 | 33 |
|  | 5 | 6 |
|  | 2.5 | 0 |
| 546254 | 20 | 76 |
|  | 10 | 51 |
|  | 5 | 36 |
|  | 2.5 | 0 |
| 546343 | 20 | 79 |
|  | 10 | 38 |
|  | 5 | n/a |
|  | 2.5 | 0 |
| 548048 | 20 | 98 |
|  | 10 | 89 |
|  | 5 | 70 |
|  | 2.5 | 23 |
| 546828 | 20 | 93 |
|  | 10 | 36 |
|  | 5 | 25 |
|  | 2.5 | 0 |
| 546251 | 20 | 69 |
|  | 10 | 52 |
|  | 5 | 30 |
|  | 2.5 | 22 |
| 547457 | 20 | 60 |
|  | 10 | 31 |
|  | 5 | 4 |
|  | 2.5 | 0 |

Example 8: Effect of ISIS Antisense Oligonucleotides Targeting Human PKK in Cynomolgus Monkeys Cynomolgus monkeys were treated with ISIS antisense oligonucleotides selected from studies described above. Antisense oligonucleotide efficacy and tolerability were evaluated. The human antisense oligonucleotides tested are cross-reactive with the rhesus genomic sequence (GENBANK Accession No. NW_001118167.1 truncated from nucleotides 2358000 to 2391000 and designated herein as SEQ ID NO: 18). The target start site of each oligonucleotide to SEQ ID NO: 18 is presented in Table 50. 'Mismatches' indicates that the number of nucleotides by which the oligonucleotide is mismatched to the rhesus sequence. The greater the complementarity between the human oligonucleotide and the rhesus monkey sequence, the more likely the human oligonucleotide can cross-react with the rhesus monkey sequence. 'n/a' indicates that the oligonucleotide is has more than 3 mismatches with the rhesus gene sequence.

TABLE 50

Antisense oligonucleotides complementary to SEQ ID NO: 18

| ISIS No | Target Start Site | Mismatches | Sequence | Chemistry | SEQ ID NO. |
|---|---|---|---|---|---|
| 547927 | 22059 | 1 | ATGGTCCGACACACAA | Deoxy, MOE and cEt | 1548 |
| 546232 | n/a | n/a | AGGAACTTGGTGTGCCACTT | 5-10-5 MOE | 526 |
| 547455 | 27391 | 0 | ATATCATGATTCCCTTCTGA | 5-10-5 MOE | 657 |
| 546254 | 23858 | 1 | TGCAAGTCTCTTGGCAAACA | 5-10-5 MOE | 570 |
| 546343 | 30532 | 0 | CCCCCTTCTTTATAGCCAGC | 5-10-5 MOE | 705 |
| 548048 | 27397 | 0 | CGATATCATGATTCCC | Deoxy, MOE and cEt | 1666 |
| 546828 | 13632 | 1 | ACAGTATCACTGTACTAGTT | 5-10-5 MOE | 904 |
| 546251 | 23846 | 0 | GGCAAACATTCACTCCTTTA | 5-10-5 MOE | 566 |
| 547457 | 27397 | 0 | AAGGCGATATCATGATTCCC | 5-10-5 MOE | 660 |

Treatment

Prior to the study, the monkeys were kept in quarantine for a 30-day period, during which the animals were observed daily for general health. The monkeys were 2-4 years old and weighed between 2 and 4 kg. Ten groups of four randomly assigned male cynomolgus monkeys each were injected subcutaneously with ISIS oligonucleotide or PBS. PBS solution or ISIS oligonucleotides at a dose of 40 mg/kg were administered initially with a loading regimen consisting of four doses on the first week of the study (days 1, 3, 5, and 7), followed by a maintenance regimen consisting of once weekly administration starting on Day 14 (weeks 2 to 13). Subcutaneous injections were performed in clock-wise rotations at 4 sites on the back; one site per dose. The injection sites were delineated by tattoo, while sedated using ketamine, and were separated by a minimum of 3 cm.

During the study period, the monkeys were observed a minimum of once daily for signs of illness or distress. Any animal experiencing more than momentary or slight pain or distress due to the treatment, injury or illness was promptly reported to the responsible veterinarian and the Study Director. Any animal in poor health or in a possible moribund condition was identified for further monitoring and possible euthanasia. For example, two monkeys treated with ISIS 547445 were euthanized due to subdued behavior, lateral position, lack of response to stimuli and decreased respiration. The protocols described in the Example were approved by the Institutional Animal Care and Use Committee (IACUC).

Target Reduction
RNA analysis

On day 87 or 88, 48 hours after the final dose, RNA was extracted from liver tissue for real-time PCR analysis of PKK using primer probe set RTS3455 (forward sequence CCTGTGTGGAGGGTCACTCA, designated herein as SEQ ID NO: 23; reverse sequence CCACTATAGATGCGCCAAACATC, designated herein as SEQ ID NO: 24; probe sequence CCCACTGCTTTGATGGGCTTCCC, designated herein as SEQ ID NO: 25). The results were normalized to the housekeeping gene, Cyclophilin. Results are presented as percent inhibition of PKK mRNA, relative to PBS control. As shown in Table 51, treatment with ISIS antisense oligonucleotides resulted in significant reduction of PKK mRNA in comparison to the PBS control.

TABLE 51

Percent Inhibition of PKK mRNA in the cynomolgus monkey liver relative to the PBS control

| ISIS No | % inhibition |
|---|---|
| 546232 | 88 |
| 546251 | 90 |
| 546254 | 88 |
| 546343 | 74 |
| 546828 | 45 |
| 547455 | 90 |
| 547457 | 89 |
| 547927 | 54 |
| 548048 | 95 |

Protein Analysis

Approximately 0.9 mL of blood was collected each time from all available animals at pre-dose, day 17, day 31, day 45, day 59, and day 73, and placed in tubes containing 3.2% sodium citrate. The tubes were centrifuged (3000 rpm for 10 min at room temperature) to obtain plasma. PKK protein levels were measured in the plasma by ELISA. The results are presented in Table 52, expressed as percentage inhibition compared to the PBS control levels. The results indicate that ISIS oligonucleotides significantly reduced PKK protein levels.

TABLE 52

PKK protein level reduction (%) in the cynomolgus monkey plasma relative to control levels

| | Day 17 | Day 31 | Day 45 | Day 59 | Day 73 |
|---|---|---|---|---|---|
| ISIS 546232 | 53 | 58 | 72 | 75 | 70 |
| ISIS 546251 | 71 | 75 | 75 | 81 | 77 |
| ISIS 546254 | 38 | 51 | 63 | 74 | 73 |
| ISIS 546343 | 56 | 74 | 69 | 70 | 70 |
| ISIS 546828 | 0 | 8 | 23 | 39 | 39 |
| ISIS 547455 | 26 | 33 | 43 | 58 | 58 |
| ISIS 547457 | 68 | 75 | 79 | 76 | 80 |
| ISIS 547927 | 8 | 0 | 15 | 10 | 18 |
| ISIS 548048 | 90 | 93 | 95 | 95 | 95 |

Tolerability Studies
Liver Function

To evaluate the effect of ISIS oligonucleotides on hepatic function, the monkeys were fasted overnight. Approximately, 1.5 mL of blood samples were collected from all the study groups. Blood was collected in tubes without anticoagulant for serum separation. The tubes were kept at room temperature for a minimum of 90 min and then centrifuged at 3,000 rpm for 10 min Levels of various liver function markers were measured using a Toshiba 120FR NEO chemistry analyzer (Toshiba Co., Japan). The results are presented in Table 53 and indicate that antisense oligonucleotides had no effect on liver function outside the expected range for antisense oligonucleotides.

TABLE 53

Liver function markers in cynomolgus monkey plasma

|  | Albumin (g/dL) | AST (IU/L) | ALT (IU/L) |
|---|---|---|---|
| PBS | 4.2 | 48 | 60 |
| ISIS 546232 | 4.1 | 63 | 140 |
| ISIS 546251 | 3.7 | 51 | 58 |
| ISIS 546254 | 3.8 | 68 | 54 |
| ISIS 546343 | 4.3 | 49 | 76 |
| ISIS 546828 | 3.7 | 75 | 67 |
| ISIS 547455 | 3.8 | 56 | 61 |
| ISIS 547457 | 4.0 | 54 | 52 |
| ISIS 547927 | 4.2 | 59 | 61 |
| ISIS 548048 | 4.2 | 44 | 47 |

Hematology

To evaluate any effect of ISIS oligonucleotides in cynomolgus monkeys on hematologic parameters, blood samples of approximately 1.2 mL of blood was collected pre-dose and on day 87 or day 88 from each of the available study animals in tubes containing $K_2$-EDTA. Samples were analyzed for red blood cell (RBC) count, white blood cells (WBC) count, platelet count, hemoglobin content and hematocrit, using an ADVIA2120i hematology analyzer (SIEMENS, USA). The data is presented in Table 54.

The data indicate treatment with most of the oligonucleotides did not cause any changes in hematologic parameters outside the expected range for antisense oligonucleotides at this dose.

TABLE 54

Hematological parameters in cynomolgus monkeys

|  | RBC ($\times 10^6$/µL) | Platelets ($\times 10^3$/µL) | WBC ($\times 10^3$/µL) | Hemoglobin (g/dL) | HCT (%) |
|---|---|---|---|---|---|
| PBS | 5.4 | 458 | 13 | 13.1 | 43 |
| ISIS 546232 | 5.4 | 391 | 11 | 12.9 | 42 |
| ISIS 546251 | 5.7 | 419 | 8 | 12.9 | 43 |
| ISIS 546254 | 5.3 | 436 | 11 | 12.4 | 41 |
| ISIS 546343 | 5.5 | 373 | 14 | 12.6 | 42 |
| ISIS 546828 | 6.0 | 408 | 11 | 12.9 | 43 |
| ISIS 547455 | 4.5 | 448 | 13 | 10.2 | 34 |
| ISIS 547457 | 6.4 | 367 | 10 | 13.8 | 45 |
| ISIS 547927 | 5.2 | 461 | 45 | 12.5 | 41 |
| ISIS 548048 | 5.9 | 393 | 11 | 13.4 | 44 |

Kidney Function

To evaluate the effect of ISIS oligonucleotides on kidney function, the monkeys were fasted overnight. Approximately, 1.5 mL of blood samples were collected from all the study groups. Blood was collected in tubes without anticoagulant for serum separation. The tubes were kept at room temperature for a minimum of 90 min and then centrifuged at 3,000 rpm for 10 min Levels of BUN and creatinine were measured using a Toshiba 120FR NEO chemistry analyzer (Toshiba Co., Japan). Results are presented in Table 55, expressed in mg/dL. The plasma chemistry data indicate that most of the ISIS oligonucleotides did not have any effect on the kidney function outside the expected range for antisense oligonucleotides. Specifically, treatment with ISIS 546254 was well tolerated in terms of the kidney function of the monkeys.

Kidney function was also assessed by urinalysis. Fresh urine from all animals was collected using a clean cage pan on wet ice. Food was removed overnight the day before fresh urine collection was done but water was supplied. The total protein and creatinine levels were measured using a Toshiba 120FR NEO automated chemistry analyzer (Toshiba Co., Japan) and the protein to creatinine ratio was calculated. The results are presented in Table 56.

TABLE 55

Plasma BUN and creatinine levels (mg/dL) in cynomolgus monkeys

|  | BUN | Creatinine |
|---|---|---|
| PBS | 22.8 | 0.9 |
| ISIS 546232 | 22.7 | 1.0 |
| ISIS 546251 | 25.4 | 1.1 |
| ISIS 546254 | 25.7 | 0.9 |
| ISIS 546343 | 26.2 | 1.0 |
| ISIS 546828 | 24.7 | 0.9 |
| ISIS 547455 | 29.4 | 0.9 |
| ISIS 547457 | 24.3 | 1.0 |
| ISIS 547927 | 22.3 | 1.0 |
| ISIS 548048 | 21.9 | 0.9 |

TABLE 56

Urine protein/creatinine ratio in cynomolgus monkeys

|  | Ratio |
|---|---|
| ISIS 546232 | 0.03 |
| ISIS 546251 | 0.12 |
| ISIS 546254 | 0.04 |
| ISIS 546343 | 0.01 |
| ISIS 546828 | 0.03 |
| ISIS 547455 | 0.70 |
| ISIS 547457 | 0.03 |
| ISIS 547927 | 0.04 |
| ISIS 548048 | 0.03 |
| PBS | 0.06 |

C-Reactive Protein Level Analysis

To evaluate any inflammatory effect of ISIS oligonucleotides in cynomolgus monkeys, the monkeys were fasted overnight. Approximately, 1.5 mL of blood samples were collected from all the study groups. Blood was collected in tubes without anticoagulant for serum separation. The tubes were kept at room temperature for a minimum of 90 min and then centrifuged at 3,000 rpm for 10 min. C-reactive protein (CRP), which is synthesized in the liver and which serves as a marker of inflammation, was measured using a Toshiba 120FR NEO chemistry analyzer (Toshiba Co., Japan). Complement C3 was also measured similarly, and the data is presented as a percentage of baseline values. The results are presented in Table 57 and indicate that treatment with ISIS oligonucleotides did not cause any inflammation in monkeys.

TABLE 57

C-reactive protein and C3 levels in cynomolgus monkey plasma

|  | CRP (mg/dL) | C3 (% of baseline) |
|---|---|---|
| PBS | 0.2 | 73 |
| ISIS 546232 | 0.5 | 50 |
| ISIS 546251 | 0.7 | 62 |
| ISIS 546254 | 0.8 | 61 |
| ISIS 546343 | 0.2 | 60 |
| ISIS 546828 | 0.6 | 56 |
| ISIS 547455 | 1.9 | 64 |
| ISIS 547457 | 0.3 | 53 |
| ISIS 547927 | 0.2 | 73 |
| ISIS 548048 | 0.2 | 69 |

Example 9: Antisense Inhibition of Murine PKK mRNA in Mouse Primary Hepatocytes Antisense oligonucleotides targeting a murine PKK nucleic acid were designed and tested for their effects on PKK mRNA in vitro. Cultured mouse primary hepatocytes at a density of 10,000 cells per well were transfected using Cytofectin reagent with 12.5 nM, 25.0 nM, 50.0 nM, 100.0 nM, and 200.0 nM of antisense oligonucleotide. After a treatment period of approximately 24 hours, RNA was isolated from the cells and mouse PKK mRNA levels were measured by quantitative real-time PCR using the murine primer probe set RTS3313 (forward sequence TGCCTGCT-GTTCAGCTTTCTC, designated herein as SEQ ID NO: 2228; reverse sequence TGGCAAAGTCCCTGTAATGCT, designated herein as SEQ ID NO: 2229; probe sequence CGTGACTCCACCCAAAGAGACAAATAAACG, designated herein as SEQ ID NO: 2230). PKK mRNA levels were adjusted according to total RNA content, as measured by RIBOGREEN.

The chimeric antisense oligonucleotides were designed as 5-10-5 MOE gapmers. The gapmers are 20 nucleotides in length, wherein the central gap segment is comprised of ten 2'-deoxynucleosides and is flanked on both sides (in the 5' and 3' directions) by wings comprising 5 nucleosides each. Each nucleoside in the 5' wing segment and each nucleoside in the 3' wing segment has a 2'-O-methoxyethyl modification. The internucleoside linkages throughout each gapmer are phosphorothioate linkages. All cytosine residues throughout each gapmer are 5-methylcytosines. Results demonstrate that PKK mRNA levels were significantly reduced in a dose dependent manner.

In one specific example, ISIS 482584 (GGCATATTG-GTTTTTGGAAT; SEQ ID NO: 2244) reduced PKK mRNA in a dose dependent manner yielding a half maximal inhibitory concentration ($IC_{50}$) of 84 nM (see Table 58). ISIS 482584 is targeted to SEQ ID NO: 11 (GENBANK Accession No. NM_008455.2) and has a target start site of 1586 and a target stop site of 1605. "Target start site" indicates the 5'-most nucleotide to which the gapmer is targeted. "Target stop site" indicates the 3'-most nucleotide to which the gapmer is targeted.

TABLE 58

Dose-dependent inhibition of mouse PKK mRNA levels by ISIS 482584

| Dose | % inhibition |
|---|---|
| 12.5 nM | 0 |
| 25.0 nM | 47 |
| 50.0 nM | 27 |
| 100.0 nM | 60 |
| 200.0 nM | 82 |

Example 10: Antisense Inhibition of PKK mRNA in BALB/c Mice

ISIS 482584 was tested for its effect on murine PKK mRNA in vivo.

Treatment

Six groups of male BALB/c mice each were treated with 2.5 mg/kg, 5.0 mg/kg, 10.0 mg/kg, 20.0 mg/kg, 40.0 mg/kg, or 80.0 mg/kg of ISIS 482584, administered subcutaneously twice a week for 3 weeks (weekly doses of 5.0 mg/kg, 10.0 mg/kg, 20.0 mg/kg, 40.0 mg/kg, 80.0 mg/kg, or 160.0 mg/kg). A control group of BALB/c mice was treated with PBS, administered subcutaneously twice a week for 3 weeks. Two days after the last dose of antisense oligonucleotide or PBS, mice from all groups were anesthetized with 150 mg/kg ketamine mixed with 10 mg/kg xylazine, administered by intraperitoneal injection. Liver was collected for RNA analysis.

RNA Analysis

RNA was extracted from liver tissue for real-time PCR analysis of PKK. PKK mRNA levels were measured using the murine primer probe set (forward sequence ACAAGT-GCATTTTACAGACCAGAGTAC, designated herein as SEQ ID NO: 2231; reverse sequence GGTTGTCCGCT-GACTTTATGCT, designated herein as SEQ ID NO: 2232; probe sequence AAGCACAGTGCAAGCGGAACACCC, designated herein as SEQ ID NO: 2233). Results are presented as percent inhibition of PKK, relative to PBS control. As shown in Table 59, treatment with ISIS 482584 resulted in significant dose-dependent reduction of PKK mRNA in comparison to the PBS control.

TABLE 59

Dose-dependent reduction of PKK mRNA in BALB/c mice liver

| Dose (mg/kg/wk) | % inhibition |
|---|---|
| 5 | 3 |
| 10 | 42 |
| 20 | 68 |
| 40 | 85 |
| 80 | 91 |
| 160 | 94 |

Protein Analysis

Plasma was collected in tubes containing sodium citrate as an anticoagulant. The samples were run on a 4-12% gradient SDS-polyacrylamide gel (Invitrogen), followed by immunoblotting with murine PKK antibody (R&D Systems). Blots were incubated with secondary fluorophore-labeled antibodies (LI-COR) and imaged in an Odyssey Imager (LI-COR). Results are presented as percent inhibition of PKK, relative to PBS control. As shown in Table 60, treatment with ISIS 482584 resulted in significant dose-dependent reduction of PKK plasma protein in comparison to the PBS control.

TABLE 60

Dose-dependent reduction of PKK protein in BALB/c mice plasma

| Dose (mg/kg/wk) | % inhibition |
|---|---|
| 5 | 5 |
| 10 | 24 |
| 20 | 47 |
| 40 | 76 |
| 80 | 81 |
| 160 | n.d. | n. d. = no data

Example 11: In Vivo Effect of Antisense Inhibition of Murine PKK in an Angioedema Mouse Model Hereditary angioedema (HAE) is characterized by local swelling and increase in vascular permeability in subcutaneous tissues (Morgan, B. P. N. Engl. J. Med. 363: 581-83, 2010). It is caused by a deficiency of the C1 inhibitor, a protein of the complement system. Two mouse models were used in this study including an established mouse model of C1-INH deficiency and a captopril-induced edema model, both of which cause vascular permeability, a hallmark of HAE. Reversal of vascular permeability is accompanied by increased plasma levels of high molecular weight kininogen (HMWK).

In the first model, angioedema was induced by treatment with Captopril, a known antihypertensive agent, which increases vascular permeability in mice and replicates the pathology of hereditary angioedema.

In the second model, angioedema was induced by treatment with ISIS 461756, an antisense oligonucleotide which targets murine C1 inhibitor mRNA, which increases vascular permeability in mice and replicates the pathology of hereditary angioedema. ISIS 461756 (SEQ ID NO: 2245; AAAGTGGTTGATACCCTGGG) is a 5-10-5 MOE gapmer targeting nucleosides 1730-1749 of NM_009776.3 (SEQ ID NO: 2243).

The effect of HOE-140 and ISIS 482584, an antisense oligonucleotide inhibitor of PKK, were evaluated in the Captopril and ISIS 461756-induced mouse models of vascular permeability. Some of the murine groups were treated with HOE-140, a selective antagonist of the bradykinin B2 receptor, which blocks vasodilation and vascular permeability (Cruden and Newby, Expert Opin. Pharmacol. 9: 2383-90, 2008). Other mice were treated with ISIS 482584, which inhibits PKK mRNA expression. The effect of treatment with HOE-140 was compared with the effect of treatment with ISIS 482584.

Treatment

The various treatment groups for this assay are presented in Table 61.

Group 1 consisted of 4 C57BL/6J-Tyrc-2J mice treated with PBS administered subcutaneously twice a week for 4 weeks. No other treatment was administered to Group 1 which served as a control group to measure the basal level of vascular permeability.

Group 2 consisted of 8 C57BL/6J-Tyrc-2J mice treated with PBS administered subcutaneously twice a week for 4 weeks. At the end of the treatment, the mice were intraperitoneally administered 20 µg of captopril. Group 2 served as a PBS control group for captopril-induced vascular permeability.

Group 3 consisted of 8 C57BL/6J-Tyrc-2J mice treated with PBS administered subcutaneously twice a week for 4 weeks. On day 14, the mice were treated with 50 mg/kg of the antisense oligonucleotide targeting C1 inhibitor, ISIS 461756, administered subcutaneously twice a week for 2 weeks. At the end of the treatment period, the mice were intraperitoneally administered 20 µg of captopril. Group 3 served as a PBS control group for captopril and ISIS 461756-induced vascular permeability.

Group 4 consisted of 8 C57BL/6J-Tyrc-2J mice treated with PBS administered subcutaneously twice a week for 4 weeks. On day 14, the mice were treated with 50 mg/kg of the antisense oligonucleotide targeting C1 inhibitor, ISIS 461756, administered subcutaneously twice a week for 2 weeks. At the end of the treatment period, the mice were intraperitoneally administered 20 µg of captopril. The mice were then also intraperitoneally administered 30 µg of HOE-140. Group 4 served as a positive control for inhibition of vascular permeability with HOE-140.

Group 5 consisted of 8 C57BL/6J-Tyrc-2J mice treated with 40 mg/kg of control oligonucleotide ISIS 141923, a 5-10-5 MOE gapmer with no known murine target, (CCTTCCCTGAAGGTTCCTCC; SEQ ID NO: 2246) administered subcutaneously twice a week for 4 weeks. On day 14, the mice were treated with 50 mg/kg of the antisense oligonucleotide targeting C1 inhibitor, ISIS 461756, administered subcutaneously twice a week for 2 weeks. At the end of the treatment period, the mice were intraperitoneally administered 20 µg of captopril. Group 5 served as a control group for captopril and ISIS 461756-induced vascular permeability.

Group 6 consisted of 8 C57BL/6J-Tyrc-2J mice and was treated with 40 mg/kg of ISIS 482584 administered subcutaneously twice a week for 4 weeks. At the end of the treatment period, the mice were intraperitoneally administered 20 µg of captopril. Group 6 served as the experimental treatment group for examining the effect of PKK ASO on captopril-induced vascular permeability.

Group 7 consisted of 8 C57BL/6J-Tyrc-2J mice treated with 40 mg/kg of ISIS 482584 administered subcutaneously twice a week for 4 weeks. On day 14, the mice were treated with 50 mg/kg of the antisense oligonucleotide targeting C1 inhibitor, ISIS 461756, administered subcutaneously twice a week for 2 weeks. At the end of the treatment period, the mice were intraperitoneally administered 20 µg of captopril. Group 7 served as the experimental treatment group for examining the effect of PKK ASO on captopril and ISIS 461756-induced vascular permeability.

All the groups were then injected with 30 mg/kg of Evans Blue solution into the tail vein. The mice were sacrificed 30 min after the Evans Blue solution administration and colons, feet, ears, and intestines were harvested. Blood samples were taken through cardiac puncture.

TABLE 61

Treatment groups

| Group No. | Treatment | Captopril | ISIS 461756 | HOE-140 |
|---|---|---|---|---|
| 1. (N = 4) | PBS | No | No | No |
| 2. (N = 8) | PBS | Yes | No | No |
| 3. (N = 8) | PBS | Yes | Yes | No |
| 4. (N = 8) | PBS | Yes | Yes | Yes |

TABLE 61-continued

Treatment groups

| Group No. | Treatment | Captopril | ISIS 461756 | HOE-140 |
|---|---|---|---|---|
| 5. (N = 8) | ISIS 141923 | Yes | Yes | No |
| 6. (N = 8) | ISIS 482584 | Yes | No | No |
| 7. (N = 8) | ISIS 482584 | Yes | Yes | No |

Quantification of Vascular Permeability

The harvested tissues from the feet, colon, ears, and intestines were placed separately in formamide solution overnight to leach out the Evans Blue dye. The formamide solution containing ear and feet tissue was heated to 55° C. and left overnight. The color intensity of the dye-infused formamide solution was then measured at $OD_{600nm}$, and is presented in Table 62. Mice displaying any manifestation of angioedema take up more dye and, therefore, demonstrate high OD values.

As presented in Table 62, treatment with ISIS 482584 prevents vascular permeability in mice treated with captopril (Group 6) and in mice treated with captopril and ISIS 461756 (Group 7) compared to the respective PBS control groups (Groups 2 and 3). Measures of vascular permeability in mice of Groups 6 and 7 were also reduced in most of the tissues in comparison to the mice treated with the control oligonucleotide, ISIS 141923 (Group 5), where vascular permeability was induced with captopril and ISIS 461756. Measures of vascular permeability in the colon and feet tissues of both the treatment groups (Groups 6 and 7) were comparable to basal levels, as observed in mice treated with only PBS (Group 1). Reduction in vascular permeability in mice treated with ISIS 482584 was comparable to that seen in mice treated with the bradykinin 2 receptor antagonist, HOE140, which served as a positive control in this assay.

Therefore, antisense inhibition of PKK mRNA may be beneficial for the treatment and prevention of vascular permeability, which is symptomatic of HAE.

Example 12: In Vivo Effect of Antisense Inhibition of Murine PKK on Basal Permeability and Captopril-Induced Permeability in Mice Basal permeability is the level of vascular permeability occurring in the tissues of naïve, untreated mice. The effect of ISIS 482584 in the prevention of vascular permeability, either basal or captopril-induced, was evaluated.

Treatment

The various treatment groups for this assay are presented in Table 63.

Group 1 consisted of 8 mice and was treated with PBS administered subcutaneously twice a week for 4 weeks. No other treatment was administered to Group 1 which served as a control group to measure the basal levels of vascular permeability.

Group 2 consisted of 8 mice and was treated with PBS administered subcutaneously twice a week for 4 weeks. At the end of the treatment period, the mice were intraperitoneally administered 20 µg of captopril. Group 2 served as the negative control group for captopril-induced vascular permeability.

Group 3 consisted of 8 mice and was treated with PBS administered subcutaneously twice a week for 4 weeks. At the end of the treatment period, the mice were intraperitoneally administered 30 µg of HOE-140. Group 3 served as a positive control for inhibition of basal vascular permeability.

Group 4 consisted of 8 mice and was treated with PBS administered subcutaneously twice a week for 4 weeks. At the end of the treatment period, the mice were intraperitoneally administered 20 µg of captopril. The mice were also intraperitoneally administered 30 µg of HOE-140. Group 4 served as a positive control for inhibition of captopril-induced vascular permeability.

Group 5 consisted of 8 mice and was treated with 40 mg/kg of ISIS 482584 administered subcutaneously twice a

TABLE 62

$OD_{600\ nm}$ of Evans Blue dye to measure vascular permeability

| Group No. | Treatment | Captopril | ISIS 461756 | HOE-140 | Colons | Intestines | Feet | Ears |
|---|---|---|---|---|---|---|---|---|
| 1 | PBS | No | No | No | 0.26 | 0.16 | 0.11 | 0.02 |
| 2 | PBS | Yes | No | No | 0.49 | 0.29 | 0.12 | 0.07 |
| 3 | PBS | Yes | Yes | No | 0.49 | 0.34 | 0.11 | 0.12 |
| 4 | PBS | Yes | Yes | Yes | 0.14 | 0.18 | 0.07 | 0.09 |
| 5 | ISIS 141923 | Yes | Yes | No | 0.44 | 0.29 | 0.14 | 0.08 |
| 6 | ISIS 482584 | Yes | No | No | 0.27 | 0.30 | 0.07 | 0.14 |
| 7 | ISIS 482584 | Yes | Yes | No | 0.21 | 0.34 | 0.07 | 0.06 |

Quantification of High Molecular Weight Kininogen (HMWK)

Western blot quantification of HMWK from blood samples are presented in FIG. 1.

As shown in FIG. 1, samples from Groups 1 and 2 have low levels of HMWK as compared to Groups 6 and 7 indicating that vascular permeability is reversed in Groups 6 and 7. Also as shown in FIG. 1, samples from Groups 1 and 2 have increased HMWK cleavage product as compared to Groups 6 and 7. Thus, lack of HMWK is caused by PKK cleavage of HMWK into cleavage products (including bradykinin and HKa).

week for 4 weeks. Group 5 served as an experimental treatment group for examining the effect of ISIS 482584 on basal vascular permeability.

Group 6 consisted of 8 mice and was treated with 40 mg/kg of ISIS 482584 administered subcutaneously twice a week for 4 weeks. At the end of the treatment period, the mice were intraperitoneally administered 20 µg of captopril. Group 6 served as an experimental treatment group for examining the effect of ISIS 482584 on captopril-induced vascular permeability.

All the groups were then injected with 30 mg/kg of Evans Blue solution. The mice were sacrificed 30 min after the Evans Blue solution administration and colons, feet, ears, and intestines were harvested.

TABLE 63

Treatment groups

| Group No. | Treatment | Captopril | HOE-140 |
|---|---|---|---|
| 1. (N = 8) | PBS | No | No |
| 2. (N = 8) | PBS | Yes | No |
| 3. (N = 8) | PBS | No | Yes |
| 4. (N = 8) | PBS | Yes | Yes |
| 5. (N = 8) | ISIS 482584 | No | No |
| 6. (N = 8) | ISIS 482584 | Yes | No |

Quantification of Vascular Permeability

The harvested tissues from the feet, colon, intestine, and ears were placed separately in formamide solution overnight to leach out the Evans Blue dye. The formamide solution containing feet and ear tissue was heated to 55° C. and left overnight. The color intensity of the dye-infused formamide solution was then measured at $OD_{600nm}$, and is presented in Table 64. Mice displaying any manifestation of angioedema take up more dye and, therefore, demonstrate high OD values.

As presented in Table 64, mice treated with ISIS 482584 demonstrated reduced basal vascular permeability compared to the PBS control (Group 5 vs. Group 1). The reduction in basal vascular permeability by treatment with ISIS 482584 was comparable to that caused by treatment with HOE-140 (Group 3, which served as the positive control). Mice treated with ISIS 482584 also demonstrated reduced captopril-induced vascular permeability in most tissues compared to the PBS control (Group 6 vs. Group 2). The reduction in captopril-induced vascular permeability by treatment with ISIS 482584 was comparable to that caused by treatment with HOE-140 (Group 4, which served as the positive control).

TABLE 64

$OD_{600\,nm}$ of Evans Blue dye to measure vascular permeability

| Group No. | Treatment | Capto-pril | HOE-140 | Colon | Feet | Intestine | Ears |
|---|---|---|---|---|---|---|---|
| 1 | PBS | No | No | 0.27 | 0.08 | 0.23 | 0.06 |
| 2 | PBS | Yes | No | 0.61 | 0.08 | 0.24 | 0.01 |
| 3 | PBS | No | Yes | 0.18 | 0.06 | 0.21 | 0.03 |
| 4 | PBS | Yes | Yes | 0.29 | 0.03 | 0.14 | 0.00 |
| 5 | ISIS 482584 | No | No | 0.19 | 0.07 | 0.22 | 0.04 |
| 6 | ISIS 482584 | Yes | No | 0.37 | 0.05 | 0.22 | 0.00 |

Example 13: Dose-Dependent Effect of Antisense Inhibition of Murine PKK on Captopril-Induced Vascular Permeability The effect of varying doses on ISIS 482584 on captopril-induced vascular permeability was evaluated.

Treatment

The various treatment groups for this assay are presented in Table 65.

Group 1 consisted of 4 mice and was treated with PBS administered subcutaneously twice a week for 3 weeks. No other treatment was administered to Group 1 which served as a control group to measure the basal levels of vascular permeability.

Group 2 consisted of 8 mice and was treated with PBS administered subcutaneously twice a week for 3 weeks. At the end of the treatment period, the mice were intraperitoneally administered 20 μg of captopril. Group 2 served as the control group for captopril-induced vascular permeability.

Group 3 consisted of 4 mice and was treated with PBS administered subcutaneously twice a week for 3 weeks. At the end of the treatment period, the mice were intraperitoneally administered 20 μg of captopril. The mice were also intraperitoneally administered 30 μg of Icatibant (HOE-140). Group 4 served as a positive control for inhibition of captopril-induced vascular permeability.

Groups 4, 5, 6, 7, 8, and 9 consisted of 8 mice each and were treated with 2.5 mg/kg, 5 mg/kg, 10 mg/kg, 20 mg/kg, 40 mg/kg, or 80 mg/kg (corresponding to 5 mg/kg, 10 mg/kg, 20 mg/kg, 40 mg/kg, 80 mg/kg, or 160 mg/kg per week), respectively of ISIS 482584 administered subcutaneously twice a week for 3 weeks. At the end of the treatment period, the mice of all the groups were intraperitoneally administered 20 μg of captopril. Groups 4-9 served as the experimental treatment groups for examining the effect of varying doses of ISIS 482584 on captopril-induced vascular permeability.

All the groups were then injected with 30 mg/kg of Evans Blue solution in the tail vein. The mice were sacrificed 30 min after the Evans Blue solution administration and colons, feet, ears, and intestines were harvested. Blood samples were taken through cardiac puncture.

TABLE 65

Treatment groups

| Group No. | Treatment | Dose (mg/kg/wk) | Captopril | HOE-140 |
|---|---|---|---|---|
| 1. (N = 4) | PBS | — | No | No |
| 2. (N = 8) | PBS | — | Yes | No |
| 3. (N = 4) | PBS | — | Yes | Yes |
| 4. (N = 8) | ISIS 482584 | 160 | Yes | No |
| 5. (N = 8) | ISIS 482584 | 80 | Yes | No |
| 6. (N = 8) | ISIS 482584 | 40 | Yes | No |
| 7. (N = 8) | ISIS 482584 | 20 | Yes | No |
| 8. (N = 8) | ISIS 482584 | 10 | Yes | No |
| 9. (N = 8) | ISIS 482584 | 5 | Yes | No |

Quantification of Vascular Permeability

The harvested tissues were placed in formamide solution overnight to leach out the Evans Blue dye. The formamide solution containing feet and ear tissue was heated to 55° C. and left overnight. The color intensity of the dye-infused formamide solution was then measured at $OD_{600nm}$ and is presented in Table 66. Mice displaying any manifestation of angioedema take up more dye and, therefore, demonstrate high OD values.

As presented in Table 66, mice treated with higher doses of ISIS 482584 (Groups 4, 5, and 6) had reduced levels of captopril-induced vascular permeability compared to the corresponding PBS control group (Group 2). The reduction in vascular permeability in mice of these treatment groups (Groups 4 and 5) was comparable to the levels of basal vascular permeability (as shown in Group 1) as well as in mice treated with HOE-140 (Group 3).

TABLE 66

OD$_{600\,nm}$ of Evans Blue dye to measure vascular permeability

| Group No. | Treatment | Dose (mg/kg) | Captopril | HOE-140 | Colon | Feet | Intestine | Ears |
|---|---|---|---|---|---|---|---|---|
| 1 | PBS | — | No | No | 0.16 | 0.07 | 0.13 | 0.01 |
| 2 | PBS | — | Yes | No | 0.39 | 0.12 | 0.18 | 0.07 |
| 3 | PBS | — | Yes | Yes | 0.15 | 0.03 | 0.10 | 0.04 |
| 4 | ISIS 482584 | 160 | Yes | No | 0.26 | 0.10 | 0.15 | 0.05 |
| 5 | ISIS 482584 | 80 | Yes | No | 0.21 | 0.04 | 0.17 | 0.03 |
| 6 | ISIS 482584 | 40 | Yes | No | 0.36 | 0.10 | 0.20 | 0.05 |
| 7 | ISIS 482584 | 20 | Yes | No | 0.40 | 0.11 | 0.20 | 0.07 |
| 8 | ISIS 482584 | 10 | Yes | No | 0.41 | 0.10 | 0.19 | 0.05 |
| 9 | ISIS 482584 | 5 | Yes | No | 0.41 | 0.10 | 0.17 | 0.05 |

Quantification of Vascular Leakage

The blood drawn through cardiac puncture was immediately mixed with 3 times the volume of ice-cold ethanol. The solution was centrifuged at 15,000 g for 20 minutes at 4° C. to remove cell debris and precipitated plasma proteins. The ethanol extracts were further purified by ultra-filtration through a 10 kDa MWCO filter. The color intensity of the ethanol extracted plasma solution was then measured at OD$_{620nm}$. The results are presented in Table 67 as percentage increase or decrease of the OD values of the Group 1 PBS control. It was expected that tissues from mice displaying manifestation of angioedema would leak more dye from the plasma and, therefore, demonstrate low OD values, whereas treatment groups may display higher OD values due to reduced vascular leakage. Mice treated with 160 mg/kg/week and 80 mg/kg/week of ISIS 482584 (Groups 4 and 5) demonstrated less vascular leakage compared to the PBS negative control treated with captopril (Group 2). The results from Groups 4 and 5 were comparable to the positive control treated with HOE-140 (Group 3).

TABLE 67

Percentage of OD$_{620nm}$ of Evans Blue dye compared to the PBS basal control to measure vascular leakage

| Group No. | Treatment | Dose (mg/kg) | Captopril | HOE-140 | Plasma |
|---|---|---|---|---|---|
| 2 | PBS | — | Yes | No | −43 |
| 3 | PBS | — | Yes | Yes | 5 |
| 4 | ISIS 482584 | 160 | Yes | No | 91 |
| 5 | ISIS 482584 | 80 | Yes | No | 40 |
| 6 | ISIS 482584 | 40 | Yes | No | −31 |
| 7 | ISIS 482584 | 20 | Yes | No | −26 |
| 8 | ISIS 482584 | 10 | Yes | No | −20 |
| 9 | ISIS 482584 | 5 | Yes | No | −23 |

Example 14: Dose-Dependent Effect of Antisense Inhibition of Murine PKK on Basal Permeability in Mice The effect of varying doses on ISIS 482584 on basal vascular permeability was evaluated.

Treatment

The various treatment groups for this assay are presented in Table 68.

Group 1 consisted of 8 mice and was treated with PBS administered subcutaneously twice a week for 3 weeks. No other treatment was administered to Group 1 which served as a control group to measure the basal levels of vascular permeability.

Group 2 consisted of 4 mice and was treated with PBS administered subcutaneously twice a week for 3 weeks. At the end of the treatment period, the mice were intraperitoneally administered 30 µg of HOE-140. Group 2 served as a positive control for inhibition of basal vascular permeability.

Groups 3, 4, 5, 6, 7, and 8 consisted of 8 mice each and were treated with 2.5 mg/kg, 5 mg/kg, 10 mg/kg, 20 mg/kg, 40 mg/kg, or 80 mg/kg (corresponding to 5 mg/kg, 10 mg/kg, 20 mg/kg, 40 mg/kg, 80 mg/kg, or 160 mg/kg per week), respectively of ISIS 482584 administered subcutaneously twice a week for 3 weeks. Groups 4-9 served as the experimental treatment groups for examining the effect of varying doses of ISIS 482584 on basal vascular permeability.

All the groups were then injected with 30 mg/kg of Evans Blue solution in the tail vein. The mice were sacrificed 30 min after the Evans Blue solution administration and colons, feet, and ears were harvested and examined for permeability defects. Blood samples were taken through cardiac puncture.

TABLE 68

Treatment groups

| Group No. | Treatment | Dose (mg/kg/week) | HOE-140 |
|---|---|---|---|
| 1. (N = 8) | PBS | — | No |
| 2. (N = 4) | PBS | — | Yes |
| 3. (N = 8) | ISIS 482584 | 160 | No |
| 4. (N = 8) | ISIS 482584 | 80 | No |
| 5. (N = 8) | ISIS 482584 | 40 | No |
| 6. (N = 8) | ISIS 482584 | 20 | No |
| 7. (N = 8) | ISIS 482584 | 10 | No |
| 8. (N = 8) | ISIS 482584 | 5 | No |

Quantification of Vascular Permeability

The harvested tissues from the feet, colon, and ears were placed in formamide solution overnight to leach out the Evans Blue dye. The formamide solution containing feet and ear tissue was heated to 55° C. and left overnight. The color intensity of the dye-infused formamide solution was then measured at OD$_{600nm}$, and is presented in Table 69. Higher OD values are associated with higher levels of permeability.

As presented in Table 10, most of the tissues of mice treated with ISIS 482584 at all doses (Groups 3-8) demonstrated reduced basal vascular permeability compared to the PBS control (Group 1). The reduction in basal vascular permeability of the ISIS oligonucleotide-treated groups was comparable to the same demonstrated in the positive control group treated with HOE-140 (Group 2).

TABLE 69

OD$_{600\ nm}$ of Evans Blue dye to measure vascular permeability

| Group No. | Treatment | Dose (mg/kg/week) | HOE-140 | Colon | Feet | Ears |
|---|---|---|---|---|---|---|
| 1 | PBS | — | No | 0.27 | 0.17 | 0.013 |
| 2 | PBS | — | Yes | 0.24 | 0.09 | 0.047 |
| 3 | ISIS 482584 | 160 | No | 0.25 | 0.11 | 0.019 |
| 4 | ISIS 482584 | 80 | No | 0.24 | 0.09 | 0.014 |
| 5 | ISIS 482584 | 40 | No | 0.27 | 0.11 | 0.011 |
| 6 | ISIS 482584 | 20 | No | 0.26 | 0.11 | 0.009 |
| 7 | ISIS 482584 | 10 | No | 0.31 | 0.10 | 0.015 |
| 8 | ISIS 482584 | 5 | No | 0.32 | 0.11 | 0.009 |

Quantification of Vascular Leakage

The blood drawn through cardiac puncture was immediately mixed with 3 times the volume of ice-cold ethanol. The solution was centrifuged at 15,000 g for 20 minutes at 4° C. to remove cell debris and precipitated plasma proteins. The ethanol extracts were further purified by ultra-filtration through a 10 kDa MWCO filter. The color intensity of the ethanol extracted plasma solution was then measured at OD$_{620nm}$. The results are presented in Table 70 as percentage increase or decrease of the OD values of the Group 1 PBS control. It was expected that treatment groups may display higher OD values due to reduced vascular leakage. All the mice in the ISIS oligonucleotide-treated groups demonstrated significantly reduced vascular leakage compared to the PBS negative control.

TABLE 70

Percentage of OD$_{620\ nm}$ of Evans Blue dye compared to the PBS basal control to measure vascular leakage

| Group No. | Treatment | Dose (mg/kg/week) | HOE-140 | Plasma |
|---|---|---|---|---|
| 2. (N = 8) | ISIS 482584 | 160 | No | 95 |
| 3. (N = 8) | ISIS 482584 | 80 | No | 93 |
| 4. (N = 8) | ISIS 482584 | 40 | No | 83 |
| 5. (N = 8) | ISIS 482584 | 20 | No | 56 |
| 6. (N = 8) | ISIS 482584 | 10 | No | 36 |

Quantification of High Molecular Weight Kininogen (HMWK)

Figure 2:
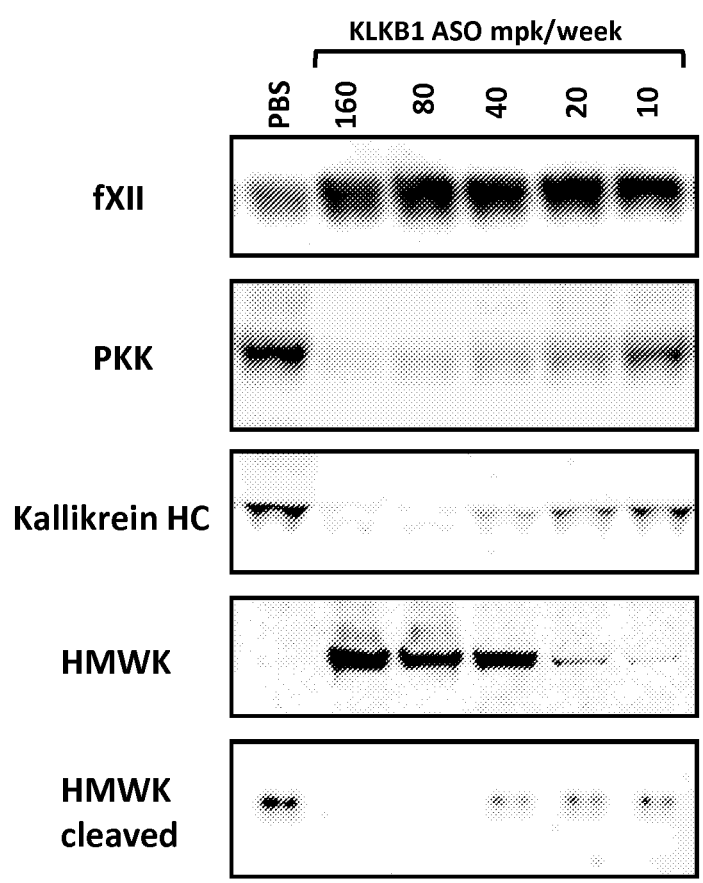
FIG. 2 is a Western blot quantification of HMWK from blood samples as described in Example 14.

Western blot quantification of HMWK from blood samples are presented in FIG. 2 and Tables 71 and 72.

As shown in Table 71, Groups treated with 482584 have higher levels of HMWK as compared to PBS control, increasing in a dose-dependent manner. Treatment with PKK antisense oligonucleotide results in stabilization of HMWK. Thus, vascular permeability is reduced in ISIS 482584-treated groups in a dose-dependent manner. As shown in Table 72, Groups treated with ISIS 482584 have lower HMWK cleavage product as compared to PBS control, decreasing in a dose-dependent manner. Thus, reduced HMWK is caused by PKK cleavage of HMWK into cleavage products (including bradykinin and HKa). Data are presented in Intensity Units as measured by densitometer.

TABLE 71

Quantification of HMWK by densitometer

| Group No | Treatment | Dose (mg/kg/week) | Intensity Units |
|---|---|---|---|
| 1 | PBS | — | 89 |
| 3 | ISIS 482584 | 160 | 21358 |
| 4 | ISIS 482584 | 80 | 7279 |
| 5 | ISIS 482584 | 40 | 873 |
| 6 | ISIS 482584 | 20 | 608 |
| 7 | ISIS 482584 | 10 | 507 |

TABLE 72

Quantification of HMWK cleavage product by densitometer

| Group No | Treatment | Dose (mg/kg/week) | Intensity Units |
|---|---|---|---|
| 1 | PBS | — | 401738 |
| 3 | ISIS 482584 | 160 | 19936 |
| 4 | ISIS 482584 | 80 | 204482 |
| 5 | ISIS 482584 | 40 | 388135 |
| 6 | ISIS 482584 | 20 | 403360 |
| 7 | ISIS 482584 | 10 | 414774 |

Example 15: Combination Therapy of Antisense Oligonucleotides Targeting PKK and Factor 12 on Captopril-Induced Vascular Permeability in Mice Mice were treated varying doses of ISIS 410944, a 5-10-5 MOE gapmer targeting Factor 12 (GCATGGGACAGAGATGGTGC; SEQ ID NO: 2247), and ISIS 482584 in a captopril-induced vascular permeability model.

Treatment

The various treatment groups for this assay are presented in Table 73.

Group 1 consisted of 4 mice and was treated with PBS administered subcutaneously twice a week for 3 weeks. No other treatment was administered to Group 1 which served as a control group to measure the basal levels of vascular permeability.

Group 2 consisted of 8 mice and was treated with PBS administered subcutaneously twice a week for 3 weeks. At the end of the treatment period, the mice were intraperitoneally administered 20 μg of captopril. Group 2 served as the control group for captopril-induced vascular permeability.

Group 3 consisted of 4 mice and was treated with PBS administered subcutaneously twice a week for 3 weeks. At the end of the treatment period, the mice were intraperitoneally administered 20 μg of captopril. The mice were also intraperitoneally administered 30 μg of HOE-140. Group 3 served as a positive control for inhibition of captopril-induced vascular permeability.

Groups 4, 5, 6, 7, and 8 consisted of 8 mice each and were treated with 2.5 mg/kg, 5 mg/kg, 10 mg/kg, 20 mg/kg, or 40 mg/kg (corresponding to 5 mg/kg, 10 mg/kg, 20 mg/kg, 40 mg/kg, or 80 mg/kg per week), respectively of ISIS 482584 and ISIS 410944 each administered subcutaneously twice a week for 3 weeks. At the end of the treatment period, the mice of all the groups were intraperitoneally administered 20 μg of captopril. Groups 4-8 served as the experimental treatment groups for examining the effect of ISIS 410944 and ISIS 482584 on captopril-induced vascular permeability.

All the groups were then injected with 30 mg/kg of Evans Blue solution in the tail vein. The mice were sacrificed 30 min after the Evans Blue solution administration and colons, feet, ears, and intestines were harvested.

TABLE 73

Treatment groups

| Group No. | Treatment | Dose (mg/kg/wk) of each ASO | Captopril | HOE-140 |
|---|---|---|---|---|
| 1. (N = 4) | PBS | — | No | No |
| 2. (N = 8) | PBS | — | Yes | No |
| 3. (N = 4) | PBS | — | Yes | Yes |
| 4. (N = 8) | ISIS 482584 + ISIS 410944 | 80 | Yes | No |
| 5. (N = 8) | ISIS 482584 + ISIS 410944 | 40 | Yes | No |
| 6. (N = 8) | ISIS 482584 + ISIS 410944 | 20 | Yes | No |
| 7. (N = 8) | ISIS 482584 + ISIS 410944 | 10 | Yes | No |
| 8. (N = 8) | ISIS 482584 + ISIS 410944 | 5 | Yes | No |

Quantification of Vascular Permeability

The harvested tissues from the feet, colon, and ears were placed in formamide solution overnight to leach out the Evans Blue dye. The formamide solution containing feet and ear tissue was heated to 55° C. and left overnight. The color intensity of the dye-infused formamide solution was then measured at $OD_{600nm}$, and is presented in Table 74. Higher OD values are associated with higher levels of permeability.

As presented in Table 74, most of the tissues of mice treated with a combination of ISIS 482584 and ISIS 410944 at all doses (Groups 3-8) demonstrated reduced vascular permeability compared to the PBS control (Group 1). The reduction in vascular permeability of the ISIS oligonucleotide-treated groups was comparable to the same demonstrated in the basal PBS control (Group 1), as well as the positive control group treated with HOE140 (Group 2). Combination of PKK and Factor 12 antisense oligonucleotides results in synergistic decrease in permeability. As expected, a corresponding synergistic decrease in vascular leakage was also observed.

Example 16: Combination Therapy of Antisense Oligonucleotides Targeting PKK and Factor 12 on Basal Vascular Permeability in Mice Mice were treated with varying doses of ISIS 410944, an antisense oligonucleotide targeting Factor 12, and ISIS 482584 in a basal vascular permeability model.

Treatment

The various treatment groups for this assay are presented in Table 75.

Group 1 consisted of 8 mice and was treated with PBS administered subcutaneously twice a week for 3 weeks. No other treatment was administered to Group 1 which served as a control group to measure the basal levels of vascular permeability.

Group 2 consisted of 4 mice and was treated with PBS administered subcutaneously twice a week for 3 weeks. At the end of the treatment period, the mice were intraperitoneally administered 30 µg of HOE-140. Group 2 served as a positive control for inhibition of basal vascular permeability.

Groups 3, 4, 5, 6, and 7 consisted of 8 mice each and were treated with 2.5 mg/kg, 5 mg/kg, 10 mg/kg, 20 mg/kg, or 40 mg/kg (corresponding to 5 mg/kg, 10 mg/kg, 20 mg/kg, 40 mg/kg, or 80 mg/kg per week), respectively of ISIS 482584 and ISIS 410944 each administered subcutaneously twice a week for 3 weeks. Groups 3-7 served as the experimental treatment groups for examining the effect of ISIS 410944 and ISIS 482584 on basal vascular permeability.

All the groups were then injected with 30 mg/kg of Evans Blue solution in the tail vein. The mice were sacrificed 30 min after the Evans Blue solution administration and colons, feet, ears, and intestines were harvested.

TABLE 75

Treatment groups

| Group No. | Treatment | Dose (mg/kg/wk) | HOE-140 |
|---|---|---|---|
| 1. (N = 8) | PBS | — | No |
| 2. (N = 4) | PBS | — | Yes |

TABLE 74

$OD_{600\,nm}$ of Evans Blue dye to measure vascular permeability

| Group No. | Treatment | Dose (mg/kg/wk) of each ASO | Captopril | HOE-140 | Colon | Feet | Intestines | Ears |
|---|---|---|---|---|---|---|---|---|
| 1 | PBS | — | No | No | 0.24 | 0.11 | 0.13 | 0.01 |
| 2 | PBS | — | Yes | No | 0.38 | 0.15 | 0.11 | 0.05 |
| 3 | PBS | — | Yes | Yes | 0.23 | 0.06 | 0.15 | 0.04 |
| 4 | ISIS 482584 + ISIS 410944 | 80 | Yes | No | 0.19 | 0.07 | 0.11 | 0.04 |
| 5 | ISIS 482584 + ISIS 410944 | 40 | Yes | No | 0.19 | 0.07 | 0.12 | 0.03 |
| 6 | ISIS 482584 + ISIS 410944 | 20 | Yes | No | 0.22 | 0.08 | 0.12 | 0.04 |
| 7 | ISIS 482584 + ISIS 410944 | 10 | Yes | No | 0.38 | 0.13 | 0.13 | 0.05 |
| 8 | ISIS 482584 + ISIS 410944 | 5 | Yes | No | 0.53 | 0.12 | 0.13 | 0.03 |

TABLE 75-continued

| | Treatment groups | | |
|---|---|---|---|
| Group No. | Treatment | Dose (mg/kg/wk) | HOE-140 |
| 3. (N = 8) | ISIS 482584 + ISIS 410944 | 80 | No |
| 4. (N = 8) | ISIS 482584 + ISIS 410944 | 40 | No |
| 5. (N = 8) | ISIS 482584 + ISIS 410944 | 20 | No |
| 6. (N = 8) | ISIS 482584 + ISIS 410944 | 10 | No |
| 7. (N = 8) | ISIS 482584 + ISIS 410944 | 5 | No |

Quantification of Vascular Permeability

The harvested tissues from the feet, colon, intestines, and ears were placed in formamide solution overnight to leach out the Evans Blue dye. The formamide solution containing feet and ear tissue was heated to 55° C. and left overnight. The color intensity of the dye-infused formamide solution was then measured at $OD_{600nm}$, and is presented in Table 76. Higher OD values are associated with higher levels of permeability.

As presented in Table 76, most of the tissues of mice treated with a combination of ISIS 482584 and ISIS 410944 at all doses (Groups 2-7) demonstrated reduced vascular permeability compared to the PBS control (Group 1). The reduction in vascular permeability of the ISIS oligonucleotide-treated groups was comparable to the same demonstrated in positive control group treated with HOE140 (Group 2). Combination of PKK and Factor 12 antisense oligonucleotides results in synergistic decrease in permeability. As expected, a corresponding synergistic decrease in vascular leakage was also observed.

TABLE 76

$OD_{600\,nm}$ of Evans Blue dye to measure vascular permeability

| Group No. | Treatment | Dose (mg/kg/wk) | HOE-140 | Colon | Feet | Intestines | Ears |
|---|---|---|---|---|---|---|---|
| 1 | PBS | — | No | 0.19 | 0.08 | 0.10 | 0.004 |
| 2 | PBS | — | Yes | 0.14 | 0.04 | 0.08 | 0.008 |
| 3 | ISIS 482584 + ISIS 410944 | 80 | No | 0.14 | 0.04 | 0.09 | 0.01 |
| 4 | ISIS 482584 + ISIS 410944 | 40 | No | 0.15 | 0.05 | 0.10 | 0.006 |
| 5 | ISIS 482584 + ISIS 410944 | 20 | No | 0.15 | 0.04 | 0.10 | 0.007 |
| 6 | ISIS 482584 + ISIS 410944 | 10 | No | 0.15 | 0.06 | 0.10 | 0.004 |
| 7 | ISIS 482584 + ISIS 410944 | 5 | No | 0.14 | 0.05 | 0.13 | 0.002 |

Example 17: Inhibition of Factor 12 Protein Activation by ISIS 482584

The effect of antisense inhibition of PKK mRNA on Factor 12 protein activation was evaluated.

Treatment

The various treatment groups for this assay are presented in Table 77.

Group 1 consisted of 8 mice and was treated with PBS administered subcutaneously twice a week for 3 weeks. No other treatment was administered to Group 1 which served as a control group to measure Factor 12 activation.

Groups 2, 3, 4, 5, and 6 consisted of 8 mice each and were treated with 2.5 mg/kg, 5 mg/kg, 10 mg/kg, 20 mg/kg, or 40 mg/kg (corresponding to 5 mg/kg, 10 mg/kg, 20 mg/kg, 40 mg/kg, or 80 mg/kg per week), respectively of ISIS 482584 administered subcutaneously twice a week for 3 weeks. Groups 2-6 served as the treatment groups for measuring the effect of ISIS 482584 on Factor 12 activation.

At the end of the treatment period, plasma was harvested from the mice for the Spectrozyme® Factor 12a based amidolytic assay for Factor 12 in plasma.

TABLE 77

| | Treatment groups | |
|---|---|---|
| Group No. | Treatment | Dose (mg/kg/wk) |
| 1. (N = 8) | PBS | — |
| 2. (N = 8) | ISIS 482584 | 80 |
| 3. (N = 8) | ISIS 482584 | 40 |
| 4. (N = 8) | ISIS 482584 | 20 |
| 5. (N = 8) | ISIS 482584 | 10 |
| 6. (N = 8) | ISIS 482584 | 5 |

Assay for Factor 12 Activation in Plasma

Plasma (5 µL) was added to 85 µL of PBS with 1 ug/ml dextran sulfate (500 kDa) in a 96 well polypropelene microplate and the solution was incubated for 5 minutes at room temperature. Spectrozyme® FXIIa (10 µL of a 2 mM solution) and 0.2 mM KALLISTOP™ solution was added and the absorbance kinetic was measured at 405 nm. Factor 12 activation was measured in the linear phase of absorbance accumulation. The results are presented in Table 78 as a percentage of Factor 12 activation measured in the PBS control sample. As observed in Table 78, inhibition of PKK by ISIS 482584 results in decreased activation of Factor 12 by its substrate, implying the that PKK is required for proper factor 12 activation.

TABLE 78

Percentage Factor 12 activation compared to the PBS control

| Dose (mg/kg/wk) | % F12 activation |
|---|---|
| 80 | 14 |
| 40 | 24 |
| 20 | 47 |
| 10 | 63 |
| 5 | 82 |

Example 18: In Vivo Effect of Antisense Inhibition of Murine PKK on C1-INH Antisense Oligonucleotide-Induced Vascular Permeability Vascular permeability induced by ISIS 461756, an antisense oligonucleotide which targets murine C1 inhibitor mRNA, increases vascular permeability in mice and replicates the pathology of hereditary angioedema. The effect of ISIS 482584 on this model was evaluated.

Treatment

One group of 8 mice was treated with 40 mg/kg ISIS 482584 administered subcutaneously twice a week for 3 weeks (weekly dose of 80 mg/kg). A second group of 8 mice was treated with 40 mg/kg of the control oligonucleotide, ISIS 141923, administered subcutaneously twice a week for 3 weeks (weekly dose of 80 mg/kg). A third group of 8 mice was treated with PBS administered subcutaneously twice a week for 3 weeks. On day 14, all the groups were treated with 12.5 mg/kg ISIS 461756 administered subcutaneously twice a week for 3 weeks (weekly dose of 25 mg/kg). A control group of mice was treated with PBS administered subcutaneously twice a week for 3 weeks but was not administered ISIS 461756.

At the end of the treatment period, all the groups were injected with 30 mg/kg of Evans Blue solution into the tail vein. The mice were sacrificed 30 min after the Evans Blue solution administration and colons, feet, ears, and intestines were harvested. The liver was also harvested for RNA analysis.

RNA Analysis

RNA was isolated from the liver for RT-PCR analysis of C1-INH and PKK mRNAs. The primer probe set for C1-INH is RTS3218 (forward sequence GAGTCCCCCA-GAGCCTACAGT, designated herein as SEQ ID NO: 2234; reverse sequence TGTCATTTGTTATTGTGATGGCTACA, designated herein as SEQ ID NO: 2235; probe sequence CTGCCCTCTACCTGGCCAACAACCA, designated herein as SEQ ID NO: 2236). The primer probe set for PKK is RTS3287 (forward sequence ACAAGTGCATTTTACA-GACCAGAGTAC, designated herein as SEQ ID NO: 2237; reverse sequence GGTTGTCCGCTGACTTTATGCT, designated herein as SEQ ID NO: 2238; probe sequence AAGCACAGTGCAAGCGGAACACCC, designated herein as SEQ ID NO: 2239). The results are presented in Table 79 as percent inhibition compared to the PBS control not treated with ISIS 461756. The data indicates that ISIS 461756 significantly reduced C1-INH mRNA expression and that treatment with ISIS 482584 significantly reduced PKK expression.

TABLE 79

Percent inhibition of mRNA expression in mice treated with ISIS 461756 compared to the untreated PBS control

| Treatment | C1-INH mRNA | PKK mRNA |
|---|---|---|
| PBS | 76 | 0 |
| ISIS 141923 | 79 | 0 |
| ISIS 482584 | 77 | 78 |

Quantification of Vascular Permeability

The harvested tissues from the feet, colon, and intestines were placed in formamide solution overnight to leach out the Evans Blue dye. The formamide solution containing feet tissue was heated to 55° C. and left overnight. The color intensity of the dye-infused formamide solution was then measured at $OD_{600nm}$. The data is presented in Table 80 as percent increase or reduction compared to the PBS control not treated with ISIS 461756. The data indicates that treatment with ISIS 482584 prevented vascular permeability induced by ISIS 461756.

TABLE 80

Percent change in vascular permeability in mice treated with ISIS 461756 compared to the untreated PBS control

| Treatment | Colon | Feet | Intestines |
|---|---|---|---|
| PBS | 13 | 70 | 27 |
| ISIS 141923 | 2 | 80 | 14 |
| ISIS 482584 | −23 | 2 | −25 |

Example 19: In Vivo Effect of Antisense Inhibition of Murine PKK in the $FeCl_3$-Induced Inferior Vena Cava Thrombosis Model ISIS 482584, which demonstrated significant in vitro and in vivo inhibition of PKK, was evaluated in the $FeCl_3$-induced inferior vena cava thrombosis mouse model.

Treatment

Three groups of 8 male BALB/c mice were treated with 10 mg/kg, 20 mg/kg, or 40 mg/kg of ISIS 482584, administered subcutaneously twice a week for 3 weeks (weekly doses of 20 mg/kg, 40 mg/kg, or 80 mg/kg). Two control groups of 12 BALB/c mice each were treated with PBS, administered subcutaneously twice a week for 3 weeks. Two days after the last dose of antisense oligonucleotide or PBS, mice from all groups were anesthetized with 150 mg/kg ketamine mixed with 10 mg/kg xylazine, administered by intraperitoneal injection. Thrombus formation was induced with $FeCl_3$ in all groups of anesthetized mice except the first control group.

In mice undergoing $FeCl_3$ treatment, thrombus formation was induced by applying a piece of filter paper (2×4 mm) pre-saturated with 10% $FeCl_3$ solution directly on the vena cava. After 3 minutes of exposure, the filter paper was removed. Thirty minutes after the filter paper application, a fixed length of the vein containing the thrombus was dissected out for platelet analysis. Liver was collected for RNA analysis.

Quantification of Platelet Composition

Real-time PCR quantification of platelet factor-4 (PF-4) was used to quantify platelets in the vena cava as a measure of thrombus formation. PF-4 mRNA levels were measured using the murine primer probe set mPF4_LTS_00086 (forward sequence AGACCCATTTCCTCAAGGTAGAACT, designated herein as SEQ ID NO: 2240; reverse sequence CGCAGCGACGCTCATG, designated herein as SEQ ID NO: 2241; probe sequence TCTTTGGGTCCAGTGGCAC-CCTCTT, designated herein as SEQ ID NO: 2242). Results are presented as a percentage of PF-4 in ISIS oligonucleotide-treated mice, as compared to the two PBS-treated control groups. As shown in Table 81, treatment with ISIS 482584 resulted in a significant reduction of PF-4 in comparison to the PBS control. Therefore, reduction of PKK by the compound provided herein is useful for inhibiting thrombus formation.

TABLE 81

Analysis of thrombus formation by real-time PCR quantification of PF-4 in the $FeCl_3$ induced venous thrombosis model

| | Dose in mg/kg/wk | PF-4 |
|---|---|---|
| PBS − $FeCl_3$ | — | 0 |
| PBS + $FeCl_3$ | — | 100 |
| ISIS 482584 | 20 | 62 |

TABLE 81-continued

Analysis of thrombus formation by real-time PCR quantification of PF-4 in the FeCl₃ induced venous thrombosis model

| Dose in mg/kg/wk | PF-4 |
|---|---|
| 40 | 34 |
| 80 | 25 |

Example 20: In Vivo Effect of Antisense Inhibition of Murine PKK in a Tail Bleeding Assay Tail-bleeding was measured to observe whether treatment with ISIS 482584 causes excess bleeding or hemorrhage in mice.

Treatment

Groups of 10 male BALB/c mice were treated with 10 mg/kg, 20 mg/kg, or 40 mg/kg of ISIS 482584, administered subcutaneously twice a week for 3 weeks (weekly doses of 20 mg/kg, 40 mg/kg, or 80 mg/kg). A control group of 8 BALB/c mice was treated with PBS, administered subcutaneously twice a week for 3 weeks.

Tail-Bleeding Assay

Two days after the final treatment of ISIS oligonucleotides or PBS, mice were placed in a tail bleeding chamber. Mice were anesthetized in the chamber with isoflurane. Then, a small piece of tail (approximately 4 mm from the tip) was cut with sterile scissors. The cut tail was immediately placed in a 15 mL Falcon tube filled with approximately 10 mL of 0.9% NaCl buffer solution warmed to 37° C. The blood was collected over the course of 40 minutes. The saline filled tubes were weighed both before and after bleeding. The results are provided in Table 82.

Treatment with ISIS 482584 did not significantly affect bleeding. These data suggest that the hemorrhagic potential of the compounds provided herein is low. These data taken with the results provided in Example 19 suggest inhibition of PKK with the compounds described herein are useful for providing antithrombotic activity without associated bleeding risk.

TABLE 82

Tail bleeding assay after treatment with ISIS 482584

|  | Dose (mg/kg/wk) | Bleeding (mL) |
|---|---|---|
| PBS | — | 0.03 |
| ISIS 482584 | 20 | 0.03 |
|  | 40 | 0.14 |
|  | 80 | 0.07 |

Example 21: In Vivo Effect of Antisense Inhibition of Murine PKK in the FeCl₃ Induced Mesenteric Thrombosis Model ISIS 482584 was evaluated in the FeCl₃ induced mesenteric thrombosis mouse model.

Treatment

A group of 6-8 Swiss-Webster mice was treated with 40 mg/kg of ISIS 482584, administered subcutaneously twice a week for 3 weeks (weekly dose of 80 mg/kg). A control group of 6 Swiss-Webster mice was treated with PBS, administered subcutaneously twice a week for 3 weeks. Two days after the last dose of antisense oligonucleotide or PBS, mice from all groups were anesthetized with 75 mg/kg ketamine mixed with 25 mg/kg xylazine, administered by subcutaneous injection.

Rhodamine 6G dye at a dosage of 5 mg/kg was injected subcutaneously to stain platelets. Alexa-647-labeled anti-fibrinogen antibody at a dosage of 1 mg/kg was injected via tail vein injection to stain fibrin. The abdomen was opened by a middle incision. The visceral mesentery was spread on a glass coverslip and the mesenteric arterioles (70-120 μm) were located by observation under a microscope. Thrombus formation was induced by applying of cotton threads (2×0.3 mm) pre-saturated with 6% FeCl₃ solution directly on the target vessel. After three minutes of exposure, the thread was removed and the color intensities of both the dyes were recorded by fluorescent microscopy (Olympus FluoView 1000 confocal laser scanning microscope) with appropriate filters for 70 min.

The results for platelet aggregation in the control and treatment groups are presented in Table 83, expressed in arbitrary units (a.u.). Platelet aggregation was reduced in mice treated with ISIS 482584 at a dose of 80 mg/kg/week as compared to mice treated with PBS. The results for fibrin formation in the control and treatment groups are presented in Table 84, also expressed in arbitrary units (a.u.). Fibrin formation was reduced in mice treated with ISIS 482584 at a dose of 80 mg/kg/week as compared to mice treated with PBS. Therefore, these results suggest that ISIS 482584 inhibits thrombus formation.

TABLE 83

Analysis of platelet aggregation by real-time measurement of fluorescent intensity (a.u.) in a FeCl₃ induced mesenteric thrombus model

| Time (sec) | PBS | 80 mg/kg/wk |
|---|---|---|
| 752 | 54 | 74 |
| 1018 | 315 | 11 |
| 1284 | 485 | 7 |
| 1550 | 654 | 0 |
| 1815 | 1079 | 0 |
| 2081 | 1164 | 0 |
| 2347 | 1452 | 0 |
| 2613 | 1440 | 38 |
| 2879 | 1689 | 148 |
| 3144 | 1716 | 129 |
| 3410 | 1845 | 169 |
| 3676 | 1865 | 131 |
| 3944 | 2055 | 87 |

TABLE 84

Analysis of fibrin formation by real-time measurement of fluorescent intensity (a.u.) in a FeCl₃ induced mesenteric thrombus model

| Time (sec) | PBS | 80 mg/kg/wk |
|---|---|---|
| 752 | 9 | 54 |
| 1018 | 86 | 7 |
| 1284 | 203 | 1 |
| 1550 | 319 | 10 |
| 1815 | 521 | 16 |
| 2081 | 598 | 15 |
| 2347 | 831 | 61 |
| 2613 | 959 | 88 |
| 2879 | 1157 | 141 |
| 3144 | 1236 | 150 |
| 3410 | 1374 | 173 |

TABLE 84-continued

Analysis of fibrin formation by real-time measurement of fluorescent intensity (a.u.) in a FeCl₃ induced mesenteric thrombus model

| Time (sec) | PBS | 80 mg/kg/wk |
|---|---|---|
| 3676 | 1629 | 160 |
| 3944 | 1822 | 128 |

Example 22: In Vivo Effect of Antisense Inhibition of Murine PKK in the Stenosis-Induced Inferior Vena Cava Thrombosis Model ISIS 482584 was evaluated in the stenosis-induced inferior vena cava (IVC) thrombosis model. Reduced blood flow and endothelial damage are hallmarks of this model, also known as the St. Tomas model.

Treatment

Four groups of 6-8 BALB/c mice were treated with 5 mg/kg, 10 mg/kg, 20 mg/kg, or 40 mg/kg of ISIS 482584, administered subcutaneously twice a week for 3 weeks (weekly doses of 10 mg/kg, 20 mg/kg, 40 mg/kg, or 80 mg/kg). A control group of 8 BALB/c mice was treated with PBS, administered subcutaneously twice a week for 3 weeks. Two days after the last dose of antisense oligonucleotide or PBS was administered, mice from all groups were anesthetized with 2.5% inhalant isoflurane. The IVC of the mice was exposed via a midline abdominal incision below the left renal vein, and was separated from the abdominal aorta by blunt dissection. A 6-0 silk tie (Ethicon, UK) was placed behind the blood vessel just below the left renal vein and a metal 4-0 suture (Ethicon, UK) was placed longitudinally over the IVC to tie the silk tie on top. The metal suture was then removed. Two neurovascular surgical clips (Braun Medical Inc, PA) were placed at two separate positions below the ligation for 20 seconds each, after which they were removed. The abdominal cavity contents were then replaced and the abdomen was closed. After 24 hrs, the IVC was exposed and checked for thrombi formation. All thrombi formed were collected and fixed in 10% formalin for 24 hrs.

The thrombi were weighed and the results are presented in Table 85, expressed in miligrams. As demonstrated by the results, treatment with increasing doses of ISIS 482584 resulted in corresponding decrease in thrombus weight. The results indicate that antisense inhibition of PKK is useful for inhibiting thrombus formation.

TABLE 85

Thrombi weights in the stenosis-induced IVC thrombosis model

| | Dose in mg/kg/wk | Weight (mg) |
|---|---|---|
| PBS | — | 10 |
| ISIS 482584 | 10 | 8 |
| | 20 | 6 |
| | 40 | 5 |
| | 80 | 3 |

SEQUENCE LISTING (2247 sequences)

SEQ ID NO: 1 - DNA, 2252 bp, Homo sapiens
agaacagcttgaagaccgttcatttttaagtgacaagagactcacctccaagaagcaattgtgttttcagaatgattttattcaagcaagcaacttatttcatttccttgtttgctacagtttcctgtggatgtctgactcaactctatgaaaacgccttcttcagaggtggggatgtagcttccatgtacaccccaaatgcccaatactgccagatgaggtgcacattccacccaaggtgtttgctattcagttttcttccagcaagttcaatcaatgacatggagaaaaggtttggttgcttcttgaaagatagtgttacaggaaccctgccaaaagtacatcgaacaggtgcagtttctggacattccttgaagcaatgtggtcatcaaataagtgcttgccatcgagacatttataaaggagttgatatgagaggagtcaattttaatgtgtctaaggttagcagtgttgaagaatgccaaaaaaggtgcaccagtaacattcgctgccagtttttttcatatgccacgcaaacatttcacaaggcagagtaccggaacaattgcctattaaagtacagtcccggaggaacacctaccgctataaaggtgctgagtaacgtggaatctggattctcactgaagccctgtgccctttcagaaattggttgccacatgaacatcttccagcatcttgcgttctcagatgtggatgttgccagggttctcactccagatgcttttgtgtgtcggaccatctgcacctatcaccccaactgcctcttctttacattctatacaaatgtatggaaaatcgagtcacaaagaaatgtttgtcttcttaaaacatctgaaagtggcacaccaagttcctctactcctcaagaaaacaccatatctggatatagccttttaacctgcaaaagaactttacctgaaccctgccattctaaaatttacccgggagttgactttggaggagaagaattgaatgtgacttttgttaaaggagtgaatgtttgccaagagacttgcacaaagatgattcgctgtcagtttttcacttattctttactcccagaagactgtaaggaagagaagtgtaagtgtttcttaagattatctatggatggttctccaactaggattgcgtatgggacacaagggagctctggttactctttgagattgtgtaacactggggacaactctgtctgcacaacaaaaacaagcacacgcattgttggaggaacaaactcttcttggggagagtggccctggcaggtgagcctgcaggtgaagctgacagctcagaggcacctgtgtggagggtcactcataggacaccagtgggtcctcactgctgcccactgctttgatgggcttcccctgcaggatgtttggcgcatctatagtggcattttaaatctgtcagacattacaaaagatacacctttctcacaaataaaagagattattattcaccaaaactataaagtctcagaagggaatcatgatatcgccttgataaaactccaggctcctttgaattacactgaattccaaaaaccaatatgcctaccttccaaaggtgacacaagcacaatttataccaactgttgggtaaccggatggggcttctcgaaggagaaaggtgaaatccaaaatattctacaaaaggtaaatattcctttggtaacaaatgaagaatgccagaaaagatatcaagattataaaataacccaacggatggtctgtgctggctataaagaagggggaaaagatgcttgtaagggagattcaggtggtcccttagtttgcaaacacaatggaatgtggcgtttggtgggcatcaccagctggggtgaaggctgtgcccgcagggagcaacctggtgtctacaccaaagtcgctgagtacatggactggattttagagaaaacacagagcagtgatggaaaagctcagatgcagtcaccagcatgagaagcagtccagagtctaggcaatttttacaacctgagttcaagtcaaattctgagcctggggggtcctcatctgcaaagcatggagagtggcatcttctttgcatcctaaggacgaaaaacacagtgcactcagagctgctgaggacaatgtctggctgaagcccgctttcagcacgccgtaaccaggggctgacaatgcgaggtcgcaactgagatctccatgactgtgtgttgtgaaataaaatggtgaaagatcaaaaaa

SEQ ID NO: 2 - DNA, 578 bp, Homo sapiens
atgctctctctctctcctgctgccttgtgaagaaggtacctgcttccccttcaccttccaccataattctgaacacggataggatgttcatggaatatgttgacaggacaaaaagttgaaactgttggcagaaacccaaagtcaatattgaagccaagcaaaatattgcctgcagtgccacattagaacagcttgaagaccgttcatttttaagtgacaagagactcacctccaagaagcaattgtgttttcagaatgattttattcaagcaagcaacttatttcatttccttgtttgctacagtttcctgtggatgtctgactcaactctatgaaaacgccttcttcagaggtggggatgtagcttccatgtacaccccaaatgcccaatactgccagatgaggtgcacattccacccaaggtgtttgctattcagttttcttccagcaagttcaatcaatgacatggagaaaaggtttggttgcttcttgaaagatagtgttacaggaaccctgccaaaagtacatcgaacaggtgcagtttctggacattccttgaagcaatgtggtcatcaaat

SEQ ID NO: 3 - DNA, 681 bp, Homo sapiens
ggaagccattcactagtcagattgaccagagattgttggtgggctgtctgttggggtctatgcacaggatttctgctggagttctaaggacaaaaagttgaaactgttggcagaaacccaaagtcaatattgaagccaagcaaaatattgcctgcagtgccacattagaacagcttgaagaccgttcatttttaagtgacaagagactcacctccaagaagcaattgtgttttcagaatgattttattcaagcaagcaacttatttcatttccttgtttgctacagtttcctgtggatgtctgactcaactctatgaaaacgccttcttcagaggtggggatgtagcttccatgtacaccccaaatgcccaatactgccagatgaggtgcacattccacccaaggtgtttgctattcagttttcttccagcaagttcaatcaatgacatggagaaaaggtttggttgcttcttgaaagatagtgttacaggaaccctgccaaaagtacatcgaacaggtgcagtttctggacattccttgaagcaatgtggtcatcaaataagtgcttgccatcgagacatttataaaggagttgatatgagaggagtcaattttaatgtgtctaaggttagcagtgttgaagaatgccaaaaaaggtgcaccagtaacattcgctgccag

SEQ ID NO: 4 - DNA, 2175 bp, Homo sapiens
agaacagcttgaagaccgttcatttttaagtgacaagagactcacctccaagaagcaattgtgttttcagtttcctgtgagggagttttctctgtgtccccacaaggcatgattctgggtctatggtgacttaagagggccacacaacaatgagtatttaattttcctcagatgtatggctacaataaacatctataggatgtctgactcaactctatgaaaacgccttcttcagaggtggggatgtagcttccatgtacaccccaaatgcccaatactgccagatgaggtgcacattccacccaaggtgtttgctattcagttttcttccagcaagttcaatcaatgacatggagaaaaggtttggttgcttcttgaaagatagtgttacaggaaccctgccaaaagtacatcgaacaggtgcagtttctggacattccttgaagcaatgtggtcatcaaataagtgcttgccatcgagacatttataaaggagttgatatgagaggagtcaattttaatgtatctaaggttagcagtgttgaagaatgccaaaaaaggtgcaccaatgacattcgctgccagtttttttcatatgccacgcaaacatttcacaaggcagagtaccggaacaattgcctattaaagtacagtcccggaggaacacctaccgctataaaggtgctgagtaacgtggaatctggattctcactgaagccctgtgccctttcagaaattggttgccaaatgaacatcttccagcatcttgcgttctcagatgtggatgttgccagggttctcactccagatgcttttgtgtgtcggaccatctgcacctatcaccccaactgcctcttctttacattctatacaaatgtatggaaaatcgagtcacaaagaaatgtttgtcttcttaaaacatctgaaagtggcacaccaagttcctgtactcctcaagaaaacaccatatctggatatagccttttaacctgcaaaagaactttacctgaaccctgccattctaaaatttacccgggagttgactttggaggagaagaattgaatgtgacttttgttaaaggagtgaatgtttgccaagagacttgcacaaagatgattcgctgtcagtttttcacttattctttactcccagaagactgtaaggaagagaagtgtaagtgtttcttaagattatctatggatggttctccaactaggattgcgtatgggacacaagggagctctggttactctttgagattgtgtaacactggggacaactctgtctgcacaacaaaaacaagcacacgcattgttggaggaacaaactcttcttggggagagtggccctggcaggtgagcctgcaggtgaagctgacagctcagaggcacctgtgtggagggtcactcataggacaccagtgggtcctcactgctgcccactgctttgatgggcttcccctgcaggatgtttggcgcatctatagtggcattttaaatctgtcagacattacaaaagatacacctttctcacaaataaaagagattattattcaccaaaactataaagtctcagaagggaatcatgatatcgccttgataaaactccaggctcctttgaattacactgaattccaaaaaccaatatgcctaccttccaaaggtgacacaagcacaatttataccaactgttgggtaaccggatggggcttctcgaaggagaaagggagattcaggtggtcccttagtttgcaaacacaacggaatgtggcgtttggtgggcatcaccagctggggtgaaggctgtgcccgcagggagcaacctggtgtctacaccaaagtcgctgagtacatggactggattttagagaaaacacagagcagtgatggaaaagctcagatgcagtcaccagcatgagaagcagtccagagtctaggcaatttttacaacctgagttcaagtcaaattctgagcctggggggtcctcatctgcaaagcatggagagtggcatcttctttgcatcctaaggacgaaagacacagtgcactcagagctgctgaggacaatgtctggctgaagcccgctttcagcacgccgtaaccaggggctgacaatgcgaggtcgcaactgagatctccatgactgtgtgttgtgaaataaaatggtgaaagatc

SEQ ID NO: 5 - DNA, 569 bp, Homo sapiens
agtgccacattagaacagcttgaagaccgttcatttttaagtgacaagagactcacctccaagaagcaattgtgttttcagtttcctgtggatgtctgactcaactctatgaaaacgccttcttcagaggtggggatgtagcttccatgtacaccccaaatgcccaatactgccagatgaggtgcacattccacccaaggtgtttgctattcagttttcttccagcaagttcaatcaatgacatggagaaaaggtttggttgcttcttgaaagatagtgttacaggaaccctgccaaaagtacatcgaacaggtgcagtttctggacattccttgaagcaatgtggtcatcaaataagtgcttgccatcgagacatttataaaggagttgatatgagaggagtcaattttaatgtgtctaaggttagcagtgttgaagaatgccaaaaaaggtgcaccaataacattcgctgccagtttttttcatatgccacgcaaacatttcacaaggcagagtaccggaacaattgcctattaaagtacagtcccggaggaacacctaccgctata

SEQ ID NO: 6 - DNA, 392 bp, Homo sapiens
  misc_feature (379)..(379): n is a, c, g, or t
ttgaagaccgttcatttttaagtgacaagagactcacctccaagaagcaattgtgttttcagaatgattttattcaagcaagcaacttatttcatttccttgtttgctacagtttcctgtggatgtctgactcaactctatgaaaacgccttcttcagaggtggggatgtagcttccatgtacaccccaaatgcccaatactgccagatgaggtgcacattccacccaaggtgtttgctattcagttttcttccagcaagttcaatcaatgacatggagggtttggttgcttcttgaaagatagtgttacaggaaccctgcctcaaataagtgcttgccatcgagacatttatggagttgatatgagaggagtcaattntatgtgtctggtt

SEQ ID NO: 7 - DNA, 802 bp, Homo sapiens
  misc_feature (760)..(760): n is a, c, g, or t
  misc_feature (775)..(775): n is a, c, g, or t
  misc_feature (796)..(796): n is a, c, g, or t
  misc_feature (800)..(800): n is a, c, g, or t
  misc_feature (802)..(802): n is a, c, g, or t
gggtaatcctcttcagttacttcaggtcatctagatgtatacgtgcaggcctgggcccagaggcgacattcctgtcttcttatattaataagaaaaagaaaacgaaatagtggttgccacatgaacatcttccagcatcttgcgttctcagatgtggatgttgccagggctctcactccagatgcttttgtgtgtcggaccatctgcacctatcaccccaactgcctcttctttacattctatacaaatgtatggaaaatcgagtcacaaaggcgagtatgcatggaaaatcgcatcacaaaggcgagtatgcatggggagcacttgctgctgtactttcatcacttttatagtctgagttcttaaaagtttcgttcatttccctcaaaacacttgaacctgcagtttcagtaggtactgttctgccaggtgcagattagttaagagattagcagacttctctgcctatcttctcttactttaaaacaaatgttaccattgaatcaaggaagcaatagccatgagaaaaaagaaggatctgacgcctttgaatgaagattcaaaacatgatcttcatgttttgtattagcttggagtaaaatccacttgctggcaatatagcccttaagcttgttgcctcttctctttgtttcagaaactagagccctgtttattctgatcaaggctctggcccactgtctttatctcagataacccaccctcttctgcacacagcatggagctaagagaaggtgtctangtatgtatatcatcngcagcataaatcccagaattngtcntn

SEQ ID NO: 8 - DNA, 2058 bp, Homo sapiens
tcacctccaagaagcaattgtgttttcagaatgattttattcaagcaagcaacttatttcatttccttgtttgctacagtttcctgtggatgtctgactcaactctatgaaaacgccttcttcagaggtggggatgtagcttccatgtacaccccaaatgcccaatactgccagatgaggtgcacattccacccaaggtgtttgctattcagttttcttccagcaagttcaatcaatgacatggagaaaaggtttggttgcttcttgaaagatagtgttacaggaaccctgccaaaagtacatcgaacaggtgcagtttctggacattccttgaagcaatgtggtcatcaaataagtgcttgccatcgagacatttataaaggagttgatatgagaggagtcaattttaatgtgtctaaggttagcagtgttgaagaatgccaaaaaaggtgcaccaataacattcgctgccagtttttttcatatgccacgcaaacatttcacaaggcagagtaccggaacaattgcctattaaagtacagtcccggaggaacacctaccgctataaaggtgctgagtaacgtggaatctggattctcactgaagccctgtgccctttcagaaattggttgccacatgaacatcttccagcatcttgcgttctcagatgtggatgttgccagggttctcactccagatgcttttgtgtgtcggaccatctgcacctatcaccccaactgcctcttctttacattctatacaaatgtatggaaaatcgagtcacaaaggcgagtatgcatggaaaatcgcatcacaaagaaatgtttgtcttcttaaaacatctgaaagtggcacaccaagttcctctactcctcaagaaaacaccatatctggatatagccttttaacctgcaaaagaactttacctgaaccctgccattctaaaatttacccgggagttgactttggaggagaagaattgaatgtgacttttgttaaaggagtgaatgtttgccaagagacttgcacaaagatgattcgctgtcagtttttcacttattctttactcccagaagactgtaaggaagagaagtgtaagtgtttcttaagattatctatggatggttctccaactaggattgcgtatgggacacaagggagctctggttactctttgagattgtgtaacactggggacaactctgtctgcacaacaaaaacaagcacacgcattgttggaggaacaaactcttcttggggagagtggccctggcaggtgagcctgcaggtgaagctgacagctcagaggcacctgtgtggagggtcactcataggacaccagtgggtcctcactgctgcccactgctttgatgggcttcccctgcaggatgtttggcgcatctatagtggcattttaaatctgtcagacattacaaaagatacacctttctcacaaataaaagagattattattcaccaaaactataaagtctcagaagggaatcatgatatcgccttgataaaactccaggctcctttgaattacactgaattccaaaaaccaatatgcctaccttccaaaggtgacacaagcacaatttataccaactgttgggtaaccggatggggcttctcgaaggagaaaggtgaaatccaaaatattctacaaaaggtaaatattcctttggtaacaaatgaagaatgccagaaaagatatcaagattataaaataacccaacggatggtctgtgctggctataaagaagggggaaaagatgcttgtaagggagattcaggtggtcccttagtttgcaaacacaatggaatgtggcgtttggtgggcatcaccagctggggtgaaggctgtgcccgcagggagcaacctggtgtctacaccaaagtcgctgagtacatggactggattttagagaaaacacagagcagtgatggaaaagctcagatgcagtcaccagcatgagaagcagtccagagtctaggcaatttttacaacctgagttcaagtcaaattctgagcctggggggtcctcatctgcaaag

SEQ ID NO: 9 - DNA, 577 bp, Homo sapiens
gttaccattctaaaatttacccgggagttgactttggaggagaagaattgaatgtgacttttgttaaaggagtgaatgtttgccaagagacttgcacaaagatgattcgctgtcagtttttcacttattctttactcccagaagactgtaaggaagagaagtaaaggaaattttatttttcaaagacagttgacatgaccatttcatattctctttccccctgtgaaggcttactctttctactgttcatttcatctaggtgtaagtgtttcttaagattatctatggatggttctccaactaggattgcgtatgggacacaagggagctctggttactctttgagattgtgtaacactggggacaactctggtgagtaacctcactttttcgtggacctgtcagggatgtctgtcatgttgatagtttgcttagtcttaaggaattatgtgtcttgttctccttggttagaagggactttgattcacttctaattccaaccattagcgtcaacgctctcttttcagtctgcacaacaaaaacaagcacacgcattgttggaggaacaaactcttct

SEQ ID NO: 10 - DNA, 37000 bp, Homo sapiens
agagcctctgcctagatttcacaggatgtgtggaaacacctggctgtccaggcagaagcctgctgcagggacccagccctcatggagaacctctattagggcagtgcagaggtgaactgtggggttggagcccacacacagagaccccactggagcactgcccagtggagctgtgaaaagagttcccccatcttccagatgccagaatggtagatccactgactggaaagttgcaggcactcagtgccggcccatgaaggcagccgtaggggctgtaccctgcaaagccacagggacagagctgcccaaggccttaacagcccacaccttgcatcagcatgccctgggtgtgagacaggggctccaaggagattattttggagctttaaaatttaatgacttccctgctaggttttgcatatgcttgggacctgtggcccctttattttggccaatttctcccatttggaatgggaacatttacccaattcctgtacccacattgtgttttggaagtaactaacttgttttttattttaaaggctcattgagggaagggacttgccttgtctcaaatgagactttggactcggacttttgggttactgtggaatgagttaagactttgggggactgttggaaagacatcattggttttgaaatctgaaaaggacatgagatttgggaaaggccaggggaagaatgatatggtttggctctgtgtcctcatccaaatctcgtcttgaattgtaatccccacatgggattacatgggaggggcctggtgagaggtgattggatcatggaggtggtttcccctgtgctgtgatctcatgatagtgagggatttaaaagtgacagtttcccctgcacatacacactctctctctcgtatcaccttgtgaagaaggtgtctgcttcccctctgccttccatcgtgattataagtttcctgaggcctccccagccatgggtaactgtgagtcagttaaacctcttttgtttataaattacccagtctcaggtagtatctttacagcagtgtgaaactggactaatacatctgggaaattctttttgtctccttcctttctgaaggacagctttgcctgatattatattcttggttgccaggttttgtactttcaatactttgaatatatcatcccactctctcttggcctacatgatttctgctgagaaatccaccaataatcttatgaagcttcccttgtatgtgaagaattgcttttctcttgcttctttgaaaattctctctttgtcatggtgaggatttcttttttttttttttttttttagatggagtctagctctgttgtccaggctggagtgcagtgtgcagtggcgcaatctcggctcactgcaagctccgtctcctgggttcacaccattttcctgtctcagcctctggagtagctgagactacaggtgcccaccaccacgcctggctaaattttttttgtatttttagtagagatggggtttcactgtgttagccaggatggtctcgatctcctgacctcatgatccacccatcttggcctcccaaagtgctgggattacaggcatgagccactgcacctggccgaggatctctttatatttaatctatttggagttcttttgggcttcataaatctggatgtttatttcatttatgtctccaaattttgagagttttctattcttatttttttaaataagtttctgcaactttctctttctctacttcttctggaactcttctaatgcatattaattttcttaacagtgtcctataagtcttgtcagctttctgcaatttttatcattccttttattactctgactgggtaatttcaaatgacctgtatctgagcatgctgattctttctcctgcttgatctagtctgctgctgaagctgtttgtgaattttttcaattcagtcattttgttctttagctccagaatttctgtttcattcttttttatggttcctatctatctttttgttgaacttctaattttgctcatgtattgttttcctgattttgtttactgtctatctatattgttttgtagcttattgagctttcttaaggcaattatttttagctcttgtcatgcagtaaagatctccatttctttagggtcacctcctgctgctttatttccttcctttggtggtttcttgtttccccgattatttgtgatcagtgtggccttgcactgaagtaggcacctatttcagtctttacatactagcttcagcagagaaagccattcactagtcagattgaccagagattgttggtgggctgtctgttggggtctatgcacaggatttctgctggagttctaaggtgggaagggctggattctgggttcattcactgtggttgtctgtattctgtgcacaaggactggcttgaagcatggatccttgggggctgacttggcactgaaatgagccttaagcctgcgtctgcaggggccagcctaacatggggatcacctggcacctgagttcatggggataggcctgttcctgagtttattcaggctgtcctgggaacaaggtccactggggtgagcccagcatctgggtccacatggcccagcatggagccaagatctctggaggctgacctggtgctggatctgcaggggatggcctggattctaggcccatgggtgccaacttggagcctggggttgctggggctaacgtggaggctagatagagtcttgggggccaggctagagctggagcaggcctgaagtctaggttttgtgtggccatcttggagcctgaagccccaggggctgacctggtctggggtgagcatggggctgaggccacagaggctggtctggcctgtggcaggcctgaatcctggtgctggggtttactggagtgggcttggtgcttgggatctgtggtgaagttaggttctatcttaactgtccctcctccatgcaagagggcatctctctccatactgtgctgcccaggcttgaaggtgagatgacaccggtaatgtgaaattgtccttcctatacacttctatgtgtcttttcttatttctgtgctgcaaccaggtggcataacctctcacctgattccttagctctagtgaagttattttcgtgcatggatacttgttcgaattgatgtttctgcaagggatgagcgctagaaactcctgttctgacaaactcctattcctattcttgctgacatcactccctgaaatagttaatatacttaacagctgaacacggataggatgttcatggaatatgttgacaggacaaaaagttgaaactgttggcagaaacccaaagtcaatattgaagccaagcaaaatattgcctgcagtgccacattagaacagcttgaagaccgttcatttttaagtgacaagagactcacctccaagaagcaattgtgttttcaggtagcaaatttttattattctgattgtttccaaataaactataatttttaagtataattttttactttatgagaaaattaatcatttatattctaatttcctgagtatgtagagagtatagataatgttcctttatgtagaaatatttaaatgtaagatgattttaaatcagaaagaatatttgattgatttaaaatttttaaatgggctttaatattttcagaggttttctttacttagggatttttggactgacattattgccattatttattaattttgtttttgcccaaatcaagaggtttcataattgtttactctctctctaccaattccctttccaacattactagccacagagttggccaatgaacaataaacacaacagtagtctggaggtctcaatttgtatcttgggaagcattataaattttccaactccctagacacaaatgtaccaaaaaaaaacccttgttttctataccagtaattgtgtgctttgtcttgcaattcagacatttacaagaaaatctaaatcaccttaaattaagatttatgttaaatgtggtctaaaaccagcagagttatgtattgttttcttttttagaatgattttattcaagcaagcaacttatttcatttccttgtttgctacagtttcctgtggtaagtgaattatctataaaacatggaattcaggctaagacaggagtagccaagcaagtggcaccacccctggagaaagctattgaacatacagcttcgggggtggagattgtccctgatgattcaggacacgtgtctatttaatgttccacaacaaggaccacttgtcaggtatattgctgtagacatatgttgcagaccagaggaaggagctcagaagtaggaatgtcttgggacttgtgttaacaaaaacttctgttcgcagatgacactctgcaaagcaaaacttgaaacaaaaaaaaattagtcctctatttttattatcaacagtaaaaaattaaactttatctgaaaattcaaaagagtgctaggcattttatagtgtctgggtccaatccaagtatctgttaggaacaccatacatagttttactctggaccgctagggaaccatttcaaaaatgaaagtaactggtttaaatttaacttagcaaaccatgcatttggatagttctaggtgaatagctttcaacaccagatttagatctcatttctctattaatttcattaatttttggagaataaaaatgattctggacatttcattaatcattacagagggagttttctctgtgtccccacaaggcatgattctgggtctatggtgacttaagagggccacacaacaatgagtatttaattttcctcagatgtatggctacaataaacatctataggtaaggtttacattcataaagagacctttttttttccaggaaaaaagacttttattccccctaaatcacaactcccctgtgtctgtccctcaaccctgatttctcttctaaaccgtaatttacaaacccatgtgcaaacccactgaaaggtgagaaggagcataagccagagacactgggaaccacagccaactacagggggtttttcatttttttgttttgttttgttttttggcaaaataaatcatgattatggctaggaaaatcagggatgtaagtaagcaaaaatttagaaactacatattgcatgtagtccccaaattcagaaacagtcatcgttaaacatcttttatttagtctttcagatatttttctacatatacctatttgcacatttcacaaaaaagagttattaactgtggacactctttgacttgcattttccacttatagctatcttttggtgcaaataagtaatatattttggagcttgctattcttctctttttatggtatttttgtgtgcacattcttatgctcttattcagttatttctgtagaatacaatttttgaaataaaaatactagattcaaaggtgtgaatatttttgaaggttttgtggtgtggtatcatgaaattaggtttcagaaagtttactccatagttgactttttctaccagctaataagagtgctcatttaccccacttaggccaactctaacaggcttctgttgctttgcatcctgacatatttatctttctggaaacagtgtcctaatttatttctgcagagctactgcctctcagttttggtccatgtggttctggtgaccctgattcttctgctgaaccagaaagtgcacacatcctcctggctgtggtgacccaatcagagccaacgtcttgcaatgaagcttttctttagacatctagaaataagactcttatgttttttttttccaatttgacttgaaacttaagacaatacacaggcctgagttgttggtactattttgctactacgtggagcttgagagtaatggtaacaccaagactggagcaagtggaaggagacatattgtccactgatgctatcagttgagcacaatgtgcagttactttttaagccagattcaccatgggctttttggctcctgaaccaatagatttcatttgttttcaagccactttgtactaggttttccatcatttgcaatcaaaaccagtatacaaacactggttatttaatttttcatttttgctaatctcagggataaaatggcttctagttgttttaacttggctatatttgtgattcttcccattttcatatacttactaatcacttctatttcttttgtaaattatcttttcatatttgttatctaattctttaaaatttgagtactttaattctcattattgtttgtggaattgttaaacaagactgaataatctgcccaaagtccatggacatgggggcccatgtaaaagctttgaaagccaccatcattatgagataaattatataatagtactttacataggctccaaaatacagcacagacacagctatcattgtcatggtcatcattatcatcatgatcaccaacttatgaggataagcaagaacacctactagaagtttctttccattcagcaacaaaattggtgtctttctagtcactcccttccctgactgtcacatagcagttcacagaggctcagttgcagaatgagaagctctgggccaggacctgccattgtatgcatccttgcatgggaactgggggctggaagaggagtgactgcttgataattatgagtcagtcaaaaccaccaactgtctgaaaaaaataggcctttttgtaactagtattgtcactaaaccaactcctccatgttttgtgcatacatgaaatctaggcaatacacttgtattcccaaaagcttccacttgaagagatctgtgctctttccaaatataaaccttacccgagaggtggtcatcttggccacacctcagagagggagagaggcagtcttgttgggttgggtggtcataatggggctcagggccaaatccccagggggtaggatagtgcagagaagatggcactctccagtgcttaataaaatgcacgtggtctaagctgcccactccctcaaaggcaataaaaaataggtactatttaaattgaagagtaactactgccccagggaatggacaggttgtcattggaatagccatggttaatggtcccagttgacaactgaaatgaatgtgctacctgaacaggaaagcttattaaccagatttcaaagacagtctttcccggtaaatccaaatttacaaattaaagccagtaaagacaccgaattctctaataatatgtggggtgcagtatattttagagctgggaataattccaaacagcaaatagttcaaaatttattttcaatttagcatatgcatgcatttgcttaaactgtcttaaaaatgagtaaaaaatactgtcagtttgtttcaatcatactgagatgaggaacaatgtttagcattgcatgctagaaaaggacacaggattgggagtcagggctgggtgaccgtcacaggactttcactaactgtgtggatcttgggcaagtctgtgtgccctgagactcagttatttaactttcttttaaaaaacatagtccagatgcagataacaaagcctgcctctaatttcccttacagaattgtgagaagctggtggagatgtttgttacaaaagtgttttgaaaatagagcaaatattattctttttaaggcatgatgttttcatagcatgtcaggcaacaggaaaaaactaagttaggattttattttattgtggggaatttatgtgcaaattattgtgcaatttaatgaaaataagccaatgttttatacagaagtacccagaaaattaaataacactatacattgttcaaatagttgccttaatatattttattttctcagcataattagagttgtattatacaggtctttgagtagtcagtcagtgggagaagttaagacaacagatatctttttattaaaattattatatgaattatcgcaaattaatttttatggttctgtcacaggatgtctgactcaactctatgaaaacgccttcttcagaggtggggatgtagcttccatgtacaccccaaatgcccaatactgccagatgaggtgcacattccacccaaggtgtttgctattcagttttcttccagcaagttcaatcaatgacatggagaaaaggtaaaagttggtatttcattattggagaagctgtttttcaaaactgaatcagttttgtgcagaaaggtgtagtataactgagagttcttcctcacacggggttcaaggaccagcttcagcaaaatcccgtcaagtggttcttacaaatgcagattcctaggccacaacccagatctgctgaaccaaagtttcttgtgaccaggaatctgcattttaaacaatcactgtgtttctttaaagtagtagaagctagtcattttctattcaaagcctcaaaatgcttgaatatcattgggctaagggattgtctcaagaaagagtctaacaggtgcacatttcatctgaataaagaaacagatttaactgtgtgacccatgatcacattagcggatagcacagtccaaagaaaataacataagacaagcattttgctgagaatgtaattgagaaagatctagaacttgtgattttgggacagggcagttctaaatggggcctatagtgagccagtttgggcacctgtggcatgatgctatgtatggtgtgtgtgtgtatgtgtgcttgtgcttgtgtgaatatgtattattaactggaaatttgtaaaagtattggaaaaatagtacttacgattttgtgtgtgtgtgtgatggagtctcgctttgtagcccaggctggagtgcagtggcgtgatctcggctcactgcaacttccacctcccaggttcaagcgattctcctgcctcagcctcccaagtagctgggattacaggcacgcaccaccacgtccagctaatttttgtagttttagtagagacggggtttcaccacattggccaggctggccttgaactcctgacctcgtgatccacctgcctctacctcctaatgtgctgggattacaggcatgagccaccgcacccagcggtaattacaatttttattaggtcagagagatgcttattaatcacgagccacagtttcatcttaatgatttttccttttgattaatatccagagtaagcttttctttgttgttcccatttccatgttcataactctttactcatcttcactctatgtgagtttaccaactagaaattggatagtcattctctgatcccacatgttaaacttgtagagaaaactcagattgtatgtgaggatcatcatattaaaagtggaggaaggttctagaattcttataaataatgaaattaacatgaaggtggacatctaagacagagggaagtcttccattaagtgcagactacaaggagttaataagcaagatgaacacgatatacaaatccagctcttatcactaagttaactttttaagtaaatgaaagtatttgcaaaaataattaccaattgagaacatagttgcctgaaagtttaagaacacaggaaaaatcattaactctttaatatggttgatttcctgtacttaaaaaatgtgagtgtaaagaaaacgcagtgatggagttagatattatggggtgttataaaattagctctaagagtgttctttccagcaagtattggggaagctatattattttccttattcctggttttatttgttagtgtgtagaaaatgctagacatttcctcaatgtatgtttattattctacttcctaagtaaagctacttttaaaataggtttggttgcttcttgaaagatagtgttacaggaaccctgccaaaagtacatcgaacaggtgcagtttctggacattccttgaagcaatgtggtcatcaaataagtggtaagttgtgaatttcttagctacatttgagttaatattggatctcgcttagaacagcttttgctcaaagtttgtactgctacagctttttggaaggcatcactcataaagataggagatggggcagtattctggacacaaaagagggacccatattcatctggacacttctattgtctttataaatcaacacatacttaatgagcctctattatttatgaggttagcgctcaagtgtaagatttgcagaaaatgaatccaaataattgtgtctcgtttccagataagaatttttaagaaaacacaagggaacatctctctcaagttcacttgagggtaatttttacatcagtgattctcaaccagcagtgattttgtctcttccactggggacatttgacaatgtctggagacatttttggtggctacaactagggaggatgctattagcatttactaagtagaggccagaatgtttgaatgctgaccaacattctacaaggcacagggcagtcgtccacagcaaataattttctggcccaaaacgtcaacagtgctgacatcaagaaactctgtgatataccactaggcccaaattgaagaactgagttctgcaaatcttgctaagaataatacttcctaaaggaaacttgaggactaggatgctagagaactttgattctgacatctgaagctactgatgtcttgggaaacagtttccaatgctatcctaataaatttaagacaaatgaactatttctcaaacatgactgggactgataagaaagtgaaaagtgctgaaaagattcaactgatgggttgtcagaatcttaaaataactgctgttattctatgtatgactatatatcattactattttattttcattatgcacaattaattttgtaggttcaaatttcagatgtttttaaatttgtcatcctttcctccctcattgatatcacctcttcaatacgtacacactttgagcctgctgtttgcattttaaccagttatcaaaggatggcaatgccttcattataaatgtgggcctgacttagccagtataataggtgtagtctacgtgaggtggagtacatttcctattttaaaagatcaatttttatgttaatccaatttggtataaattattcgagtaagtgctatttctgattgttgtatcttgtagcaaaatttaaagaaaaagtaatttgtgcctttctcaatattcctgttattgttcatgtattctaaaactcactgttactcacttagcttgcttttaatgttttttaaagtgaaaaattgttcccaagtacataaaatctctacactcaagaacaattctagtcaaaagcatttagagcttccgtatgaacacttaaagagtttttatttgtaagagtcgcatcccaactcttagcctgttcttttctcacatgcagaaaaataggaaagagacttcgtttccacagtctgcaaattcctgtgtttaagaaccacagtgaataatccacctccctgcccaactcatcgtactgtcatatagttttcctgacagtttgtgtattttctgtctttcccacccttaaatttagttttatgacttcaaccatacttcttaggagtggaaaggtatctgtagtagattatggtttattccacataatcttggggaataaaactttaaaaaagtatacagtttatacttctggttacattacttccttaaccaaaagtctaaccaagaaatttgaatctttaaaaaaaaaagaggccgggcgcggtggctcacgcctgtaatcccagcactttgggaggccgagacgggcggatcacgaggtcaggagatcgagaccatcctggctgacacggtgaaaccccgtctctactaaaaatacaaaaattagccgggcgtggtggcgcgcgcctgtagtcccagctactcgggaggctgaggcaggagaatggcgtgaacccgggaggcggagcttgcagtgagtcgagatcgcgccactgcgctccagcctgggcgacagagcgagactccgtctcaaaaaaaaaaaaaaaaaaaagagcctaattttgcttcactgtctgtgaaaagaattatctgtatcttttgcatgtaagacaaatctcaatgaaaagggtgcttaaatagaagttaacactattttaaagcaagaatggaagtggtttcatcatgcgtaaacaacaactctccacattttgtaatgattgatctggatgcaatttgtcatcagacaggagaagtcgaaagcaaagaaataacactgggagatagagaagctctttcattcaatgcgaaaggtcaaaggcacatcagtttctttaataatgcaaacctcagcacacattatcagtgtcctcattattattgccttgtttatttcccactgctcattgataatttcaacgtgaaatttacctgtattgctgcatgcatcttgcagtttaagaagtgaagtaacccaatttcaaagctagtgctttagggaaaatattggattgtatttacttcaagcagagttcgataatttatgtacataataaaaattttaaatcccttagttaatatagcagttgccaaaactgggctattatcattctaaactaccaacccaaatggtagtgggtatctaatctacctctagaaagaaaatggactgtatttgctctatgtatttttcttgtacagcttgccatcgagacatttataaaggagttgatatgagaggagtcaattttaatgtgtctaaggttagcagtgttgaagaatgccaaaaaaggtgcaccagtaacattcgctgccagtttttttcatatgccacgcaaacatttcacaaggcagagtaccggtgagtacaattcaaggtgtgtgttctttgtattggtgcctccaggatttcactgtattcttcttaacctcttttgttcccaaactaaaaaccaaacagggcttttattctaaccactttcctcatttacttactctattttatttttttatcttttatttatttatttatttattgagatggagtcgcgctctgtcgcccaggctagagtgcagtggcgtaatctcgactcactacaacctccgcttcccgggttcaagcgattctcctgcctcagcctcccgagtagctgggattacaggcgtccgccaccatgcctggctaatttttgtatttttagtagagtcggggttttactatgttggtcaggctggtctcgaactcctgatcttgtgatccacccacctcagcctcccaaagcgctgggattacaggcatgagccactgcgcctcgcccttcattttttaattaaataattcatttaatttcatttgtttctctactcttttcccctggcatgtaattgtaccgcatcttcaaagcctgacatcctcttcccctacttctccaaagctgattcttgcaggtctttcctcaaataccgtcccctccaaaagcccatttctgagcattctcttttaagtcacactcagctctgtttatttcattcatagagctaatcacaatttgatattaacttgtgatttttttccttatttttaaatcttatttttatttgcatagatgtatggggtacaagtgtaattttgttactttgatgtattttacagtggtaaagtctgggcttttggtatatccatcactggagtcatgtacattgtacccactaagctatttttcaacgcccgcccccttcccacctctctgtcaccttcccagtctctactgtctatcgctccatgctctactcaattttggtgtcattttttcctgaagcaaaattttggtgtcattttttctgaagtcattttctgaagtctgtgtcatttttcgctttcctgaagcgaattttggtgtcatttttcctgaagttccgtttgccccacacataggccttgcttatagaatgagggtttagtgtcacggagtctcctgcctcattctcaccctaacttttcctttacccctttgcgaggggaaggatgtccattaggttaataatgcagacccctaacccactcattatcagggtcattgtttttccactgtgcattttaatactaactgttacctgcactgctccctgcccctcaaagtgcagaaagcaaagtaacctcttttcttcccattcaggaacaattgcctattaaagtacagtcccggaggaacacctaccgctataaaggtgctgagtaacgtggaatctggattctcactgaagccctgtgccctttcagaaattggtaattgtaggactacttcactttgtgattgtggtaggtggaataggagcccccagagacgtccctgtgctgagccctgggacctgtgcgtgtgttcccatagctggcaaaagcgtttctgtcaatggcatgcagttacgggcttcgagatggggagtttactctggattttctgaatgggcccaatgtactcacagggttgagtgctcacaaggctcataagaaaaagagagaggcggaaggctcagagccagagagagaggtttgaaggtattacactgctggctttgaagatgaaggtccgtgagccaaggaatgcaggcggcctctagaagttgaaaagggcgaggaaagagtttccctgtggagcgtcctggaggaagaagccctgctgatgtcttgattttagcccagtaagacccaatctctagaacagtaagataattaatttgtgttgtttttaaccactaagtttgtggttatgcccctagagcagcagttataggaaactagtacagtgatactgttagagttataggacagtgatataggacagtgatactgttatagttataggaaactagtacagtgatactgttagagttataggacagtgatataggacagtgatattgttatagttataggaaactagtacagtgatactgttagagttataggtacagtgatattgttatagttataggaaactagtacagtgatactgttacaggtacagtgatataggacagtgatactgttataggaaactagtacagtgatactgttagagttataggtacagtgacataggacagtgatactgttatagttataggaaactagtacagtgatactgttagagttataggtagagtgatataggacagtgatactgttatagttatagaaaactagtacagtgatactgttatagttataggacagtgatataggacagtgatattgttatagttataggaaactagtacagtgatactgttagagttataggtacagtgatataggacagtgatattgttatagttataggaaactagtacagtgatactgttagagttataggtacagtgatattgttatagttataggaaactagtacagtgatactgttataggtacagtgatataggacagtgatactgttataggaaactagtacagtgatactgttagagttataggtacagtgacataggacagtgatactgttatagttataggaaactagtacagtgatactgttagagttataggtacagtgatataggacagtgatactgttatagttataggaaactagtacagtgatactgttatagttataggacagtgatattgttatagttataggaaactagtacagtgatactgttagagttataggtacagtgatataggacagtgatattgttatagttataggaaactagtacagtgatactgttatagttataggacagtgatataggacagtgatattgttatagttataggaaactagtacggtgatactgttatagttataggtacagtgatattgttatagttataggaaactagtacagtgatactgttagagttataggtacagtgatataggacagtgatattgttatagttataggaaactagtacagtgatactgttatagttgtaggacagtgatattgttatagttataggaaactagtacagtgatactgttagagttataggtacagtgatataggacagtgatactgttatagttataggacagtgatattcttatagttaccgtggtatagttatagttaaaggtacagtgatattgttatagttataggacagtgatattgttatagttataggacagtgatgtagttacagtgatataggtacagtgatattgttatagttataggacagtgatatagttataggacagtgatattgttacagttataggtacagtgacgttgtaatagttataggacagtgatattgttatagttataggtacagtgatgttgtagcaaaactgtaaggtcattccttggttgtgtccctatctagtgaaatgactctaccaggggtagggaaataaaactctgtcgtttcacacataaaggtaatttcaatggaattatccagaaaattgccatgacattccacctcatttagcatgtcaggatgttaatgacaagatgttactaaaagcaaatcccttacggccagttttccgcagtactgggtgctggctctgtgcctggccctgtattgggtgctgggctaggatttccctgtggaagattgggaaggttggttacaaggtggctattttcctgtctcctctttgcgacagcacaccttctccatggtgtgtgccaggttcacgtgtactggtgatttaattttaacgttcatattatttttttctgggagagtttttgaaggctgccaggaggcaggactcgatgcaaacatgctccattctgtacccagccctgttgctggaaggatttgctgcacttacccagggaacaggcaagctcgtgctgtggctctgggctgtcacagctgctgtccacacctgggagagcaccctggatggctcatctgtgtacttgctttcttgttaaattgcagtgagttcacatgtgatttaatcggatcaaatggcctttacagactgataaaaatatggctgtttcaggtggtgttttgagctgctaagggcgtggcttttcactgagtacgtggtccccgttcctcagggaacacccagtagccacatgcctcctaaacctagagtagggctgtctcctggcctaactgcccaaatgagattcataagttagggatgatctgtagttatcactacagatttgtccttggtttcaccaaggattttcctaattttacaaacaaaacccctaaggctcctggaaggagggtagaagtgaaggtgctccgggggcaacacagctgatgagctgaaccagaactcgacccttgggtcacacacatttcacagtgctcactccaccttttgtttttttaatggatttaatggtgttttaaagcctcctgcctctcaacacatatgaattcattatatttacagatttccttctcttgtggtccatcttcctgcatagatcttgagagatgtcaggctaaccacgtttcctcagttaatttaacaaaaccatttgcaactctgacatggaaaattcctaccatgtgacttattaatttatcaattgagatggtacacatattttcaagccaaaaggaggaaaacataaattggaaaaaaaaggtttttttatttttatcacctctggggaagaaagtctgataaacgaagctggttgataaaattgcaattaggggaagcaacatcatggtttctgttcggaggctaaccagatggcatacttgaaatagagaatgtcctagaaatcaactggttgcttggccaaaatatctataaatagtgcccaacatattagataggaaaagcaaagtaaaaacaattttaacaggttaggacattgggctgaagtattgcatatatttaatgtcatgtgcgtccgtgtgaagagaccactaaacaggctttgtgtgagcaagaaagctttttaatcacctgggtgcaggcaggctgagtccgaaaagagagtcagtgaagggagatggggtggggacgttttataggatttgggtaggtagtggaaaattacagtcaaagggggttgttctctggcgggcagcggtggggggtcacaaggtgctcagtgggggagcttctgagccaggagaaggaatttcacaaggtaacgtcatcagttaaggcaggaaccggccattttcacttcttttgtctttcttcagttacttcaggtcatctagatgtatacgtgcaggcctgggcccagaggcctgacattcctgtcttcttatattaataagaaaaagaaaacgaaatagtggtaaagtgttggggtggcgaaagtttttgggggtggtatggagagataatgggcgatgtttctcagggctgcttcgagcgggattaggggcggcgtgggaacctacagtgggagagatgaagctgaaggaatattttatggtaaggggtgatattgtggggttgttagaagcagcatttgtcatatagaatgattggtgatggcctggatatggttttgtgtgaaatgagaaactaaatggaagacacaaggtctgaataagagaaggagaaaaacaggtgttaaaggactaagaattgggaggacccaggacatctaattagagagtgcctaagggggttcagtgtaattacttgcttggttggtgagtttttgggctctatccttgacagagtcctcctttttaagttggaggctgagcttggtgaggtgtgtttttaaaagaccattagtctgttctacctttcctgaagattgaggatggtgaggggtatgaaggttttactgaataccaagagcctgagaaactgcttgggtgatttgactaataaaggccggtctgttatcggattgtatagagatggaaaggccaaactgaggaattatgtctgacagaagggaagaaatgaccacggtggccttctcagaccctgtgggaaaggcctctacccatccagtgaaagtgtctacccagaccaagaggtattttagtttcctgactccgggtatgtgagtaaagtcaatctgccagtcctgggcgggggcaaatccccgagcttgatgtgtagggaagggagggggcctgagcaatccctgaggaggagtggagtagcagatggaacactgagcagttattttttgaggatagatttttacgacggaaaggaaaagtgaggttttaagaggtgggttagtggcttgtaacttacatggaagagtttatgaaatgatgacagaatagaatgggcctgtgaggctggaggagatattttccttggtccaagaattatttgccttgtgtgggaagagattgataggtggaagtttcaatgggggagtagatgggagtgacagatgaggaagaaaaaaactggctgtgagggatagaagttggaatgctcgctgcttttttagctaccttatcagcataggcattgtcctgagcagtgggatctgatgccttttggtggcccttgcagtgaatggcttcagcttcctttggaagtaaagtggccttgagaggagtttttattaaagaggcattaagatggagaacccttgtgtagtgaggaaacctccttcagcccatataaccgcatggtggtgcagaatatggaaggcatatttagagtcagtataaatattgacacgtagtccctttgcaagagtgagggcctgagttaaggcaatgagttcagcttgctgagaggtagtggagcggggcagagcagtagcctcagtgatagatgtggaagatactacagcatagcctgcctttgctggtgagtggtgattaggcctggtggaactgccatcaataaaccaagtgtgatcagggtaaggaacaggaaagaaggaaatatggggaaatggagtggatgtcaggtggatcagagagatacagtcatgggggtgggggccagcctaaaacagtaaggtcaagttgtttgaacagaaaggctacagggcgtggtcctggctcttgtgtaagaattttgactgcgcagccctgcacttcggctgtgtgtaatgaaaagggttgggatgagttagggagagctagtgtgggagcagtttctagggctgtttttaaggaatggcaagaggagtggctaaaggatttaggatctttggggtcagctagctttgcttttgtgagtttatataatggtttagtcaggatggtaaaacttagtatccaaaggcggaagtacttaaccatacctaggaagaaaaggagttgttttgtagaaggggttggggtttgggagatgagccagacacaatcagcagggagagcacatgtgttttcatgaagaattatgccgagataggtaatggatgaggaagaaatttgggcttgactgaagtaatgggggctgtcctcgaagccttgtggcagtacagcccaagtaagttgctgaggctgacgggtgtcagggtcagtccaagtgaaagcgaagagaggctgggatgaagggtgcaaaggaatagtaaagaaagcatgtttgagatccagaacagaataatgggttgtggagggaggtattgaggataggagagtatatggctttggtaccatggggtgaataggcaagacaatttggttaatgaggcacagatcctgaactaacctgtaaggcttgtccggtttttggacaggtaaaatgggggaattgtaaggagagtttataggcttcaaaaggccacgctgtaacaggtgagtgataacaggctttaatccttttaaagcatgctgtgggatgggatattggcattgagcggggtaagtgtgattaggttttaatgggatggtaaggggtgcacgataggttgccaaggagggagcagaggtgtcctatacttgtggattaaggtggggacacacaaggggaggatgtgaaggaggctttgaactggggaaagggtggcattgaggtgtggctgtggcctaagaacagtcagggaagcggataattgagttaaaatgcctcgacctagtaagggagctgggcaggtggtgataactaaaaaggagtgcataaaagaatgttgtccaagttggcaccagagttggggagttttaagaggtttagaagcctggcggtcaatacctacaacagttatggaggcaagggaaacaggcccttgaaaagaacgtaatgtggagtgggtagcctctgtattaattaagaaggggatggatttaccctccactgtaagagttacctaaagcatctgtgatggtccaggaggcttctaaggtgatcgggcagcgtcagtcttcagccgctaagccaagaagatctgggaagcagtcagtcagagagccttgggccagagttccaggggctctgggagtggcagccaggccagttagacagtccgatttctagtggggtcccacacagatgagacacagcttaggaggaatcccaggctgcgggcattccttggcccattggccagatttctggcacttgaaacaagatcctgatggaggaggtcctgtaggaatgcttgaccactgcagtttaggcattttgaagtttttgtgtgtgctggagatgtggctgggttttgtctcacagcagaggcaaggaatcgcaactcagaaatacattgctacttggctgcctctattattgtacatcttgaaggcgaggttaattaagtcctcttgtggggtttgagggctggaatctaatttttggagtttttttttgtttgttttttggttttttttttttaatgtcaggagctgactgggtgataaaatgcatattgagaataagaggccttctgacccttctgggtctagggctgtaaagcgtctcagggttgctgccaaacgggccatgaactgggctgggtttttcatatttgatgaaaaagagcctaaacgctaactgatttgggagaggtcggataaataaaaaggaacattaatcttgactatgcctttagctccaaccacctctttaagaggaaattgttgggcaggtgggggagggctagtcgtggaatgaaactgtaagctggaccgggtgtgaggaggggaggtgatagaaggattatagggtggaggagcagaggctgaggaagaattgggatctggcttggcctggcaaggagcagcctggggaggaggggagaggtcagatgggtccatagaaaaggaggattggaaagactcagcaacacttggggttgggattgagaggacagatgggttgggattgaggggacagatgggagggaaagaaggaagatttgggacaagttgcattgggaacagagactagggagggaccaatgtgtaaaagaatgcctggacgtcaggcacctcagaccgtttgcccattttatgacaagaattatctagatcttgtaggatggaaaaatcgaaagtgccgttttctggctatttggaaccattgtcgagtttgtattggggttaagcagcattgcagaagaaaataaggcatttaggttttaggtcaggtgtgagttgaagaggttttaagttcttgagaacataggctaagggagaagaaggaggaatggagggtggaaagttgcctatagtgaaggaggcaagcccagagaaaagagagggtagagacatggagagaaggggtgggggggtgcttgcccccaggaaagtggttcttgccactaagggtgaaggatcaaggcaggcattcgcgcggtgatcagatacctctgaaacgtgggtgaataatcaagcaggtgtccctgcagtgattaaacagcaaggaaagactatcttcccaagtccatgaccagtgccagagttttgggttcatggataaaacgcgtctcctctgtctctaccagaaaatgaaaggaattgaaattaagagaagggagagattgaaggatggcgccaagattgaaaggaaaaagaggttgagggatagggagagaggttggataagagagtaaaaagaggctgcttacccaatttaaaatcggtgagatgttccttgggcttgttggtctgaggaccagaggtcatgggtggatctttctcatggagcaaagagcagggggacaggggattgatttcccaagggaggtcccctgatctgagtcacagcaccaaatatcacgtgtgtccatgcgaagagaccaccaaacaggctttgtgtgagcaagaaagctttttaatcacctgggtgcaggcgggctgagtccaaaaagagagtcagtgaagggagataggggtggggacgttttataggatttgggtaggtagtggaaaattacagtcaaagggggttgttctctggcgggcaggggtggggggtcacaaggtgctcagtgggggagcttctgagccaggagaaggaatttcacaaggtaacgtcatcagttaaggcaggaaccggccattttcacttcttttgtcattcttcagttacttcaggccatctggatgtatgcatgtaggcttgggcccagaggcctgacatttaacatggataaatgtaaagttcttagaatcatacatacactttggaaaagatggggcttaatcgcactttataagacttgaaggatgtttgagaatcactatgaaactgctgaaaataccaagaaaatttaattcttatgtatataaataatgtgtctgttttacatgaatcccttctacaagcttggtatttaatatggcatatattgttttttcatagtagatttaaaatttttgatatctaatttagataacataaaattaaccctttgaaagtgtacaactccgtggtttttagtatatccacctgattgcacaacgatcaccactgtctagttccagaacatttttatcaccacaaaagaaaggctgtatccaggccgggcacggtggctcacgcctgtaatcccagcactttgggaggccgaggcgggcggatcacggggtcaggagattgaaaccatcctgggtaacacggtgaagccctatctgtactaaagatacaaaaaaattagctgggcatgatggcagatgcctgtagtcccagctactcaggaggctgaggcaggagaatggcctgaacccaggaagcggagcttgcagtgagccaagattgcgccactgcactccagcctgggcgacagagcaagactccatctcacaaaaaaataataaaaataaaataaaaaaaaaaaagaaaggctgtctttctcctttcccattggccgtctttctccattccctactcctccaatcccctggcaaccactaaatctactttccatgtctgtggacttgactcttcgggacattttacataaatggaatcatgcaatgcagcacattttgcatctggcttttttcacctggcgtgttttcaaggctcattcgtattctagcatatatcaatactttgttcctatttaggactaaataagattctattgtatgaataaaacatattttgtttatatacttagtttgatgaacatttgagttgtttctggatttttttttttttttttttgcctcttatgaataatgctgctatggacaacagtttttgggtaggcatgcattttaaattctcttatgtatatacttaggattaaaattgctggatcacagagtaactccatgtttaactttttgatgaattgccaaactgtttttgagagcagctacacaatgttacattcttaccagcaacaattgagggcttcagtctctctacaaccttaacaacacttgttattgtctttgtaattattgcctttctaggcagtgtgaagtggtgtctcactgtggttttgatatgcatttccctaatgactaacaatgttgtgtatcttttcgtgtgctcattttcaatttgaatacattctttgggaaaatctctgtttaaatcttttggccattaaaaataattgggttattttcattgttgagttgtatgaactctttatatactctggatactacactcttatgacatatattattttcaaaaattttctgtgcatctgcaggtcatcttttcactttactgatggtgttctttgaagcaccaaagtttttaaacttgatgaaatccagtctggctttattcttgcacgtgctttacctaaaacgccaaaacctaattcatggttttgaagatttttgcttatgatttgttcttagaggtttatagttttagctcttacatttaggcatttgatgcattttaaattaaattttgtatatggtgtaaagtagcaatccaacttaattcttgcatgtgggtattcagttattccattgtcttgaaacccttttcaaaatcaattgtctataaatgtaagagtttatttttggaccatcagttctatcctgttgacctatatatgcctatcctaatgccagttacacacagtcttgattaccataactttgcagtaagttttgaactcagacagtctgagtgcttttattttgtcctttttcaagattaatttggttattccggatcttttgcatttccatatgaattttaggatggttgtcaatttctgcaatagaaaagcagcaggattttgatagagagtgcattgaatctgtagaccaatgagtatcaatggaattatgtgttatcaaatttagtaaactacataaacgatatgtacacaactaaaacaaaactaagatataagatcatattaatgtaatgataataaaagtggattgtctcctgttctaattttaataggcacaaggcatttttgttaatcacttcttattaaagaattttttataatattcaggaaaatacaacaaaaaaacccttacattcctaaggcctcagagtcagagtaatataaaggaaatgtaaacacatgctgagtaatgcaagcatttggcaatggtggtgactggagctgggagcacagcttttatttctctgaaataggaatttgccccttagagttagaccaattttgccttcctctaaatggcaaacagtttggagatactttaaaggacattttttcacttaggatgtttagtactatgaataataaatagtcacaatttccttaactatggtgacaaaatacaagcaaatttagcctcatgtcatttcctaaggaacatcttctctctgtgagttcacaggttgccacatgaacatcttccagcatcttgcgttctcagatgtggatgttgccagggttctcactccagatgcttttgtgtgtcggaccatctgcacctatcaccccaactgcctcttctttacattctatacaaatgtatggaaaatcgagtcacaaaggcgagtatgcatggaaaatcgcatcacaaaggcgagtatgcatggggagcacttgctgctgtactttcatcacttttatagtctgagttcttaaaagtttcgttcatttccctcaaaacacttgaacctgcagtttcagtaggtactgttctgccaggtgcagattagttaagagattagcagacttctctgcctatcttctcttactttaaaacaaatgttaccattgaatcaaggaagcaatagccatgagaaaaaagaaggatctgacgcctttgaatgaagattcaaaacatgatcttcatgttttgtattagcttggagtaaaatccacttgctggcaatatagcccttaagcttgttgcctcttctctttgtttcagaaactagagccctgtttattctgatcaaggctctggcccactgtctttatctcagataacccaccctcttctgcacacagcatggagctaagagaagggtgtctagttatgtaatatcatcggcagcataaattcccagaatttgttctttgatttttttgtttgtttttccagttagaaggtggaacttcatcattgtcctcttttcaggttgtctgtgcctattagttttctccagagggagaggtggcttgatttacatttaatctctgcaatttattagagtcctgtagttggatttactttgaagagagtttcccagaagaataaaatttgctgcgttgctttttgggtgtgagctgcttttgtatttgcctaatgcctttaatgcaaatttctttctttctctcttgcttttttttaaaaaaaatagaaatgtttgtcttcttaaaacatctgaaagtggcacaccaagttcctctactcctcaagaaaacaccatatctggatatagccttttaacctgcaaaagaactttacctggtaatgtgatttgataataatattacataaaatgtaacctatttcatgacttttaacagcaacagtgatgaaacaatcctcaaggtaacagaaacttgtgtaaatgtcgttcattgcttttcccatctgatatctttttgtgtttataattgacacagaaccctgccattctaaaatttacccgggagttgactttggaggagaagaattgaatgtgacttttgttaaaggagtgaatgtttgccaagagacttgcacaaagatgattcgctgtcagtttttcacttattctttactcccagaagactgtaaggaagagaagtaaaggaaattttatttttcaaagacagttgacatgaccatttcatattctctttccccctgtgaaggcttactctttctactgttcatttcatctaggtgtaagtgtttcttaagattatctatggatggttctccaactaggattgcgtatgggacacaagggagctctggttactctttgagattgtgtaacactggggacaactctggtgagtaacctcactttttcgtggacctgtcagggatgtctgtcatgttgatagtttgcttagtcttaaggaattatgtgtcttgttctccttggttagaagggactttgattcacttctaattccaaccattagcgtcaacgctctcttttcagtctgcacaacaaaaacaagcacacgcattgttggaggaacaaactcttcttggggagagtggccctggcaggtgagcctgcaggtgaagctgacagctcagaggcacctgtgtggagggtcactcataggacaccagtgggtcctcactgctgcccactgctttgatgggtaagtgttggatgcatctcatccagagtcttatcttggcttttcattttgaaggatctatgatcagctgcttcaccgccatgtgactttatgaatagagacgtgttaaagcggggatggtattcacaacatttaacttatagggtccaagcactgaccaacctgaccattagaacagagtgtggtctctgtacagggcagatggcgctgagtgggtattctccacagaaagagaaacgaagacagtaccccactcctccaacccaccacccaccaccaatcccaccaccaattccaccaccaatcctgccacccaccaccaatctcaccaccaatcccaccaccaatcctaccacccaccatcaatctcagcaccaatcccaccaccaatcccaccaccaatcccaccacctaccccaccaccaatcccgccacccacgaccaatcccaccaccgatcccgccaccaatcccaccaccaatcccaccacctaccccaccaccaatcccgccacccacgaccaatcccaccaccgatcccgccaccaaccaccaatcccaccaccaatcccaccaccaatccctgatgtgttcttcaaagacttatttgtcaggcccatagaaatgttacttcttgctctttgattcataaatatactaagtcataataatttttaaaagtgagagtttcgtactctgtatatttcaatgtatataatttgatctatttcaatttattggtcaaatagtagacatgttaggtaagtcttaaaatactgaggctttggagttagacagaacatggcttaagtgacagctttgctgcttattagaggtgtggccctagaagatttgtaaatccctctgagctttatttgatctaaaatatgaatagtaatagtcccgaatttgtaacgttgttgggaagattaagtgacacatttaaaatgcttagtactgtgtgtagaacataaacacttcaaaaaatgtaaactgtgatttctatattcaataagaaatgtagaaatggacaaagcatataaaaagcaaaagaaatactagaagacacttgatttttctcaaaaataaacacaccaagtatttttgttttagtgaaattcatgcttacatgctgtatactaggattgaacatactgccaccaaaatatagcagtcggtggtacatgtgggtggagcaagacccctccaccttgtcatcgtgtgaaggggctctgccatacatgaccttgcatgtgactttaaggtggttggcctggaagaaaagtcccaagatgggaaatagtaggtgtcttttttactaaatgcactccaatttgggaccaaaaattttcattcttgaaggctcagtattgtgagtttataagagataatagacataaaagtgtaatgatttcattgcaaataaaaaaaggcccctttgcacctgatatctccatcatttttctagaattttgtgcacacatgccttgcactacttggtgatgataaagatttccagatctttgcacagaataaggctttgctttagatcagaattttggatgtacttagtatacattcatcttttaaataatctatttacattttcatactttccaaaatacagatatattttattttatttatatatttatttaatttattttttgagatggagtctctctctgttgcccagagtagagtgcagtggcacaatcttggttcactgcagcctctgcctcccgggttcaagcgattctcctgcctcagcctcctgagtagctgggattacaggcgcgcgccacacctggctaatttttgtatttttagtagagacgaggtttcatcatgttggtcaggctggtctcgaactcctggcctcaagggatccacccacctcggcctcccgaagtgctgggattacaggtgtgggccactgtgcccagctgtatagagatattttaaacaacactaaagtcctcctactttgactaattagaagagcattagaagatcagcctgacttcttgacagttctgaatttagtggagcaatgaggttcagctttggtgaatgagcttaatttttccatgataaactgctagtttcttcccactacagtgtctctcaaaaatgggacagcaacattctttttgttttcacttgcagtaagcatgatgcaattacataaatgtacacttttcaatttgttaaatagaatcttcagagattcactactgccgctattggtgatgaaaaattaccagaaggaggaattaggtaggagaaaatgtgtcctatgtatttccttcccagttctttgaaagagagtgataggaaaaaggaacactattgaaggaaggactgcccagtttcaaacaggtatttatttttctctcctaggcttcccctgcaggatgtttggcgcatctatagtggcattttaaatctgtcagacattacaaaagatacacctttctcacaaataaaagagattattattcaccaaaactataaagtctcagaagggaatcatgatatcgccttgataaaactccaggctcctttgaattacactggtatgtagcatatgtaagaaggtggagagcagaattgcgctggttgatattttcatatcagtttgaacaagagggcagacctagagagactgtcgtcgttttctgactggtggagttgagggaaacgtgagggttgctgggaagtgaagaccccgcgacttgccgtgaaatctcttctacttaaagagcaagacatgtgaattaattctttcagggagggatacaactgcatgcaggtgatggaaataatgggcgtgggaaatgtctgtgccgtctgagaggcactgggcttgctttgacaagagtagcagaactgtcattgctttgggcttagggatattcgaatgtgtgagggcaagtgggatcagatatctacttccaggtataatttgggtaggaaagagactcatgcagaaagaagccctggaaggccagagcatcgtggtcagaggtgttgcctttggagggtcattgctgccaggagccgaatacccactgtatccaataacattcatggtcaggaatggtggctcacacctgtaatcccaacactttgggatgcccaggtgggaggattgcttgaggccaggagtttgagaccagcctgggcaacacagtgagaccccgtctctacataaaattagaaaaaaacaattaactgggtgtggtggtgtgcacctgtagtcccagctagtcaagaggctgagacaagaggatctcttgagcccaggagctcaaggctgtagtgagccaagatcgtgccactgcacacaaacaattatgtgacctcgggcaagttgctttacctctttacacctcttaatttccttatctgtaaaatgaggatgataatttcttcctgggtctgttgtaataattaatacatcaaagcacttcatgtctggaacagtgaagataccctgctatgactattaaggatagtatacatggaataagacacaggaacttctaaatgcttttgaccatagatttaggttctgagttttaagaatttaactcaggaaattgtaacaccaaaaatgtcatgtgaaaaatggtggtgacaaattttcttgaatcattagccttagaggttgggcagaaagcaaaaaattattcttgatgctactctatagaaagagaagacagaaaaagagaaagatgtatttttaaagtctatatccataactttatttgaccaaactctaatttaaaaattatgtttcagaattccaaaaaccaatatgcctaccttccaaaggtgacacaagcacaatttataccaactgttgggtaaccggatggggcttctcgaaggagaaaggtaagcatgacgctttaaatattgcttctagagtaagtctcacatgttgaaatacatggagtgggtcgttttaatcggtttctgtctgaaattatatctaaactctttatctttcctatctatttattcccaaatatttattcagttattcttaaaaaatgtatttttgctttggcttgaaaaaaaattttagggagacttttaagcatcttacttcattataaagatcagttgcttgactttgcatgaagcagattgggcccttctagggctgacaagcccgtgcaagaccacccgctcctcagtgttagtagcgttcccgtctcccaaaaccatgttctcccttgatgctaatggccgggagcacaggcaggtgtgtcgtctcactatggagaataatatttgtgtcattctttacagaagaaggtagcttgccaaactgtctccatctttcccgattcagtcttttgttcaagtaattcacatttttagattttttattggtaatctgagacaagaagaaatttaaagtaatcttcactaagccatgaaagctcccaacattgttctccatgagagatgctggcctgcatttattcaaaaacaaaagacccctctgttgccaaagctcggagggcttttcagaaacgatatagttgtaaattataattttgaatatataaagcaaaaaaatgaaaagtgagaacttccaggctttggattgttgtaggtgataaatataaaatgggatttctggggggctgctactgagatgaggggatggcagaaaacatggaagcaaggtctctggtcagcccagggtgctgggcttgtcccaacaccacgtaggcaataagaggacagtacagggtgccgtctctctccctcttcctctctctgtctctctctctctgtgtgtgtgtgtgtgtgtgtgtgtaacactaccttcccaatttttactgtctatttgtattcaaagataaggtccttatgaaaaatacactgctctgattcactttaaaacttatttccatatttattatttattgtgggaataataatattcccaatattattatttattatttaagttattattattaacttccctctgaggttatatattggttactcacaggtgaaatccaaaatattctacaaaaggtaaatattcctttggtaacaaatgaagaatgccagaaaagatatcaagattataaaataacccaacggatggtctgtgctggctataaagaagggggaaaagatgcttgtaaggtaactcatgagattatgaaaaacacaataggctgcttgagaaaattcatttcaaaatatattttccaatagcataattcaatcatagtttttaaaaaaattcagagacaaatgatctgataaattgataagcaacttttaacaaattgaatatacataatatatatttatattatttatgatatatgtcacaatctatgcatgtgctatttaagaggggcaaatatacatgcaataattgtgctagaatataaaaacattagacttcatcattgggatgatgatatcaagatttctttgttagatttatttcagatagaaaaggggatacgaaaaatgcaggcacatgagatacttggagaactttaagaaagagtgagtgtgtgtgtgtgtgtgtgtgtgtgtgtgtgtgtgtctggcaagcaaggtcttgcacacacacagcactttgggaggccaatgcaggtggatcacttgagcctaggaatttgagaccagtctgggcaatgtgatgaaacccatctctacaaaaaaatatgaaagtatctgtgtgtgtgtgttgctgtgtagtggactacagaactttagaggcagtcacttatttgaatcccattgtcgtaactttctactattttatttttccactgtgactcagggagattcaggtggtcccttagtttgcaaacacaatggaatgtggcgtttggtgggcatcaccagctggggtgaaggctgtgcccgcagggagcaacctggtgtctacaccaaagtcgctgagtacatggactggattttagagaaaacacagagcagtgatggaaaagctcagatgcagtcaccagcatgagaagcagtccagagtctaggcaatttttacaacctgagttcaagtcaaattctgagcctggggggtcctcatctgcaaagcatggagagtggcatcttctttgcatcctaaggacgaaaaacacagtgcactcagagctgctgaggacaatgtctggctgaagcccgctttcagcacgccgtaaccaggggctgacaatgcgaggtcgcaactgagatctccatgactgtgtgttgtgaaataaaatggtgaaagatcacgattagcaagtgttttcttctggttgtgaaacagaactgaaagtaagtggttgaggttccagcacagttcctgggatccctctaattgcactgcttcctctggaactcagtatatctcaaagatgtaatttcctctccgtgctgcacctggtcggccactgaaacccactattgcctgcttcacgtgtggcaaagagctagcgggcttgggttttgttctgccgagaggaagggagaacacccacttttataagaaagagatgggttacctgaacccatgggcacctttgcctcttggcctcctaactttgctaccagggcatggctaggagggtccaggctgcgcgtgctgaggagctcgaggggctgcagcattgcacagccttcatggcaggcaaggaatctgctttgcaaggggcattagccctggaggctcagtggatatgggctattgcaatagtaattcaaggagcatttttaggcctggcgtggtggctcacgcctgtaattccaacagtttaggagatcaaggcaggtggatcacttgagcataggagttcgagactagcctggccaatgtgacgaaaccccatctccacaaaaattagctgggcatggtggtgcgcacctgtaatcccagctcccccagaagctgaggcaggaggaccgcttgagcccggggatgtcgtggctgcagtgagctgagatggcaccactgcatcactgcattccagcctgggcaacagagtgagactgtctcaaaaaaaggaagcattgttaggtataaattattattattattattattagtagtagtagtagtagtagtagtactgagacggagtcttgctctgttgcccaggctggagtgcagtggtgcaatcttggctcactgcaatctctgcctcccgggttcacgccattctcctgcctcagcctccggagtagctgggactacaggcacccgccactgtgcttggctaattttttgtatttttagtagagacgggtttcaccatgttagccagaatggtctcgatctgctgaccttgtgatccacccgcctcggcctcccaaagtgctgggattacaggcttgagccaccacacccagccctgttaggtataaattatttcataaaattcagacttgtaaatttatggtagcctttggaatgggtgatagatgtcctatgccacacaaattcctcacatgccgaggctcaccgtaactgataccagctcgcttgattcagttcagttaaactgaacaacatttacacagaattggcgatttacaaaatcttatgtaagttaagtagaaaaacagaaaaaagttttctgaaagagtttgggtttttccttcaatgctcaagacagaggtccccaacctttttggcaccagggaccagttttgtggaagacagtttttccatggaccagcatggtggtgggggatgattctggaatgattcaagtgcatgacatttattatgcactttatttctattattactacattgtaatatataatgaaataattatgcaactcaccataatgtagaatcagtgggagctctgagcttgttttcctgcaactagacagtcccatctgagggtgatgggagacagtgacagatcatcaggcattagattctcataaggagcctagatccctcacatgtgcagttcataacagggtttgagctcctatgagagtctcatgctgctgcggatctggcaggaggcagagctcaggcggttatgcttgctggcctgccactcacctcctgctgtgcggcctggctgctaacaggccatggaccaggtactgttctgggccccgggggttgggaacccctgctcagagacacaccgggtggtaggaggagctaaaggtggagagggtgaaggaaaatatgaggtctgggctatccacaaaccagatagcaggaaactgaagagttaaacatttacttcagaattgaatggcttttgtaaaatctggctagattccatgaaacgattttaaaaatgcactatttaaattttgcctttgcatgcgatgaagacattagtctttgttcatgtggatgtttttttatgtttaaaagggaaaaaatggtttgcaatgaaacttttatctcagtctttgagtattgatcatggggtgttggaacaggactttggaatgcttgcagggtaaacctttggcctctgttagtcagggaatgacctagtttggcaaaacagaggagagttttgaaatatggaactttcccgaggcatacattgtcattttaaagtggtcaatcaaagcccagtaggactgggctggtgtcttggtgactcactgtgtgctcatatacaggggtaactgaggagcccttcacacaggtctagcctcgtgggactaaaaagtgtgacatgggctaggaaaatgcgaggctgggatgccttcactcccatgaggaagcgtgacgggaggaggcgtgggccactggcagttctacttcacaaaggctgctggcagtgtcaatcctgcaagctggccttgccctcctgtggcggcagtgtacacgtggcatgcaagcacatgcacaagccacctggctccaaggtcagccaagggctccaacatctgtctcagtccc

SEQ ID NO: 11 - DNA, 2472 bp, Mus musculus
agaccgccctcggtgccatattcagagggcttgaagaccatcttcatgtgaagactccctctcctccagaaccacaacgtgaccatccttccaggatgattttattcaaccgagtgggttattttgtttccttgtttgctaccgtctcctgtgggtgtatgactcaactgtataaaaataccttcttcagaggtggggatctagctgccatctacaccccagatgcccagtactgtcagaagatgtgcacttttcaccccaggtgcctgctgttcagctttctcgccgtgactccacccaaagagacaaataaacggtttggttgcttcatgaaagagagcattacagggactttgccaagaatacaccggacaggggccatttctggtcattctttaaagcagtgtggccatcaaataagtgcttgccaccgagacatatacaaaggacttgatatgagagggtccaactttaatatctctaagaccgacaatattgaagaatgccagaaactgtgcacaaataattttcactgccaatttttcacatatgctacaagtgcattttacagaccagagtaccggaagaagtgcctgctgaagcacagtgcaagcggaacacccaccagcataaagtcagcggacaacctggtgtctggattctcactgaagtcctgtgcgctttcggagataggttgccccatggatattttccagcactctgcctttgcagacctgaatgtaagccaggtcatcacccccgatgcctttgtgtgtcgcaccatctgcaccttccatcccaactgccttttcttcacgttctacacgaatgaatgggagacagaatcacagagaaatgtttgttttcttaagacgtctaaaagtggaagaccaagtccccctattcctcaagaaaacgctatatctggatatagtctcctcacctgcagaaaaactcgccctgaaccctgccattccaaaatttactctggagttgactttgaaggggaagaactgaatgtgaccttcgtgcaaggagcagatgtctgccaagagacttgtacaaagacaatccgctgccagttttttatttactccttactcccccaagactgcaaggaggaggggtgtaaatgttccttaaggttatccacagatggctccccaactaggatcacctatggcatgcaggggagctccggttattctctgagattgtgtaaacttgtggacagccctgactgtacaacaaaaataaatgcacgtattgtgggaggaacaaacgcttctttaggggagtggccatggcaggtcagcctgcaagtgaagctggtatctcagacccatttgtgtggagggtccatcattggtcgccaatgggtactgacagctgcccattgctttgatggaattccctatccagatgtgtggcgtatatatggcggaattcttagtctgtccgagattacgaaagaaacgccttcctcgagaataaaggagcttattattcatcaggaatacaaagtctcagaaggcaattatgatattgccttaataaagcttcagacgcccctgaattatactgaattccaaaaaccaatatgcctgccttccaaagctgacacaaatacaatttataccaactgttgggtgactggatggggctacacgaaggaacaaggtgaaacgcaaaatattctacaaaaggctactattcctttggtaccaaatgaagaatgccagaaaaaatacagagattatgttataaacaagcagatgatctgtgctggctacaaagaaggcggaacagacgcttgtaagggagattccggtggccccttagtctgtaaacacagtggacggtggcagttggtgggtatcaccagctggggtgaaggctgcgcccgcaaggaccaaccaggagtctacaccaaagtttctgagtacatggactggatattggagaagacacagagcagtgatgtaagagctctggagacatcttcagcctgaggaggctgggtaccaaggaggaagaacccagctggctttaccacctgccctcaaggcaaactagagctccaggattctcggctgtaaaatgttgataatggtgtctacctcacatccgtatcattggattgaaaattcaagtgtagatatagttgctgaagacagcgttttgctcaagtgtgtttcctgccttgagtcacaggagctccaatgggagcattacaaagatcaccaagcttgttaggaaagagaatgatcaaagggttttattaggtaatgaaatgtctagatgtgatgcaattgaaaaaaagaccccagattctagcacagtccttgggaccattctcatgtaactgttgactctggacctcagcagatctcagagttacctgtccacttctgacatttgtttattagagcctgatgctattctttcaagtggagcaaaaaaaaaaaaaaa

SEQ ID NO: 12 - DNA, 260 bp, Mus musculus
gagtgtaaacactggagccaagcaaagaccgccctcggtgccatattcagaggggttgaagaacatcttcatgtgaagaatccctctcctccagaagcacaacgtgaccatccttccaggatgaatttattcgaccgagtgggttattttgtttccttgtttggtactgtctcctgtgggtgtatgagtggactgttaaataatacctctgcagaggtggggatctagttggcatctagacccctgaggacgagtagtga

SEQ ID NO: 13 - DNA, 30000 bp, Mus musculus
atgagaagttattttaaatttaattttttaaagtttatttattcaccccttgccacgctctccagtcgagtcagtttgacaagcagaagcttggaagctggccgtgaggaaaagagtttcatggaagctccctcctggagtctggcactctctttaatctctttaacccatacattaattttccactcccatgttagtctagtgtatggatccacgtgccctctattaagcattaccctattataagtgccatttaagattgaattctgacatagctaaagcctctcccagtgttccaagatcccagtttacagcaaggtagtttaacctattcagtaactaattaagcattacaatagacagagccattaactcagttgtctgcagaaagagcctgggaatctcactgagatagaaatctttactacaggctacattccatgccaagagcaagttgatatactatactgatatatggggaattcttcagacaagataagattttacaagacctaggaatttaggggtccatgacactacattattcttgaggcctgtcaagagttaaaaccccctggtgctattaacactaaagtgtgaaactcttgcctggcattagcctgatcctaggcagggctggtaatttctattgtaaacatttatctagttcctgcaaattcctttcttgcttgtatctggtaaatttcagtgtaccttgtcttattgtgatttgtagctcctgataattcgttgtaatataaaatagtctaatgttcgaccagagattacattcagattcaacacctctcttgtgtgcatctgtttgtcaatttaatcctaagctttgcccacctactctagagacccgttctacacagacacagggacccagagggtctgcagcaacctcttgcatggttatgtgtgcacacacagaagaagtataggtgtggtggtcaaaggacacttttagggggttgccttactccctccactgtgcaggttctggggatagaactccagtcattaggcttgacagtaaatgcctttgaccccctgagatatcctgcaagctccaccatgattttaggctttaaaaacatgcaaacctattagtcatttatctcttcaatagattctgggttagccaactgtgcagttagagttgaatgtgcaaggctgtttgaatctcgggtccatagaaaatagcctggcatcagggtccattgcaattacattgatgattgagtccctgggctcatgcttggatacccagttcaatggggccagtatcttatgatcgaggactggcttaaagtgcagatgttgaaatgagcctagaaactgagcctccagaggcaatgtccaaactcaagcccacgggcatgagtttgttcccaaatctacaattacagtcctggaaaagattctacgggggtagtagacccggtgactgggcctgaggttaacatcctggagcctgggtctgcagggtctggccggatactggaatttcctgggatgggcttgttttcagacccgtgaaaagtaatgtttacatcactcttcttcatgcatttggaacacatctccttgctgcgctgcttaggattggtaggagggtttcacggttaatgtgaaaagtctaacattcctcaatgcatattcactaggtccacattttcaaccggggttggggggtgcaacctatcatctggattccttaacaactcggaaggcatttttttttgtgcacagagaattgttcccatggattcttctgcaaagggacccattttggagcctccagctctgtcatcgtgtttatatgacttcttgaaattggtaacatattaagtagctgaacctggactgggatgtccgtggactatattgacaggttaaacagttgaaactgatgccagaaacccagtgtaaacactggagccaagcaaagaccgccctcggtgccatattcagagggcttgaagaccatcttcatgtgaagactccctctcctccagaaccacaacgtgaccatccttccaggtagctgctttctaccggtcttgttatttcctgtgtcttgggtttttttttttcaatataactatttctgcatgaacaaaagctcactggtataatgcactaatttcctgagtttttagaaaatctacaaggagttgtttttctttctatacaaatatattaatgtaaaatattttaaaaccaagaataagtttttgattcttttcaaagatgtcctttctgtgaaggttgtgggtgatattattgtccttattcataataattttgcattaatctggaaatttaataagtgtttttaattatttgtattaactctttacaaaattattagaaataaatcttcaaaattaacaataaatacactaatacacactgatagtaatctagaggtctcaatttggatcttgggaagcatgataaatattttaattttctatatacaaaatatcccacagccaaatcttccttctcctggtgattatgtgctgtgatttgcaacttagacatttatcaaaaaggtgaagtctacatgaagttaaattgtctattaaatacatggtaaacatgatctcaacctagtagttatatgtatatttttttctttcaaaggatgattttattcaaccgagtgggttattttgtttccttgtttgctaccgtctcctgtggtaagtattagtttaaggagttcaaattaatagtgtgtgagagaggaatggtcttgcaatctataccactcctggaggaagcctttaactgtacagctttgggggacaaggcagctgttgatactccaaggcaagaacttagatacattaccccaaacacagatgaacagggggaggaacttagagacatcactgcacctgttagcagaaatatctgttttgagtttactctttaacagagcctctcccacccccgcagagttgtttgtctttataatatcagccttctaaataaaaactctacctgaaaattggaaataatatcagatattgcataatgatttgagtctaatccaggtatctgattagtatatagtatttttaatataagacatacagagccatttctaaactgaaagtacctgctttgggtttcacaagtatagtatccctttggcagtctggagggacagctttcaacactcgatgtcagtgctctttccctgtttattcctttgcttttcaggatatgagcatggatggccctgaacagcccctctcaacagtcattatagagggagatttccctgggtataacatgtcaggtgtattctgagtcaaagctgacttagatatagccacacgcaaggattgttttcttcttctttttttttttttttttttttttttggttttttggttttttggtttttcaagacagggtttctctgtgtagccctggctgtcctggaactcactctgtagaccaggctggcctcgaactcagaaatccacctgcctctacctcctgagtgctgggattaaaggcgtgtgccaccacgcctggcaaggattgttttcttgactttcaagtatatggcaaagataggcttgtccttgtaagtagaagtcatttctctaggtaagctcttttttcccatccctctctgctccctacatctggcccatcatctgtaactgctctcctgtaccataactactgccatgttcaaaccaactaaacacgaatagtgataaccagagatgctatgggccatggctataaaattcataatcatgacaggaaaatgagacatgggaatacatataatacttgaaaacaaatactttatataatcctaaagtacaaaataatgatcgccaattttttctttagtctttcatatttttccgcatgaatctatctgttgtataaagtgttattcatgaataataattttaattaaaaattatgaacactaatgaaaaataattttaacttacctttggtatttatagctaatgttaatgcaaatgaacatttatgttatttgttcttcttcatggatattttgtaagtatggacattctctgcacatatccaattatttctatagattaaatttttggaaataaagattttagatagaggagtatgaatacctttgaaggctttatagcatgcattatggtattagcttctagacaggcattctctgtttggttttccccacaagcatgtggaagtgaattaacaatacaatctcttagaaatgagatgtcaatattaaatacgttttatgttaaaaaataaaatttacaggttcacaacactggtttaaacagctaggttaacaaagattaaatttgaaacaatcaatatttgtgcgctggctttgatcacaaatgaaagaaaatcaagcagtacagctttaatataaatgagtttaagagttcagaaatccatgtgcccagtgaatggcttctggagtacttagacactgcccaatgatggcacccgcacatagtgtgtctgcattgctttactgcattgtacgctgctgccttcatctcaggatgcacaatagcaaggcaggaccagcagcccaagtcgccttggaaacaaaagtaaatcggagccttttcctaagtctgagaacaagcctgttacagactagctctggtcaggtcattgtaccagctctgtgtgcagttctggctctggtctgattggctggagcatcaacagcagaagcatcacctccagcaacatatggaccaccacttgtagatggttcctcaggaggaaatctggatgccaattcagcaaggtggctctatgccaggctacaaagtaacagatgcctattggagctcactgttctaagtgggcaggcatggtgcaggaggagctgagagttctacatcttcatcaaaaggctgctagcagaatactgagttccaggcagataggatgagggtcttataggccacacccacagtgacacacctactcctacaagcacacctactcccacagggccacaccttctaatagtgtcactccctgagatgaacacatacaaaccatcacagtgcccatttgctgcaaagagaggcttcgttgatgtgggacagtcactacagttatctagggaaggtggtcatctcactgttagcagctttcatatacttacagttatttacactcctttggtaaattatcttttcatatctgacattgaatgtttaaaacattttagcatttatctatttttgtatctatgtctgcacacgcatgtgcacatatacacatgtgctgtggagcacgtgtggagatgaaggggcatcttgtggaggtcaagaggtcaatttgaaaactgaagggcctcattacaggttgtttaggttaaataaactctgtacaaataatgctgttgttataatcattaccaccaccttcgttatcattgctgccgttatcattgcaactgaggaggataagcagtcccacagttagaatgtgtctagtcactctttttcattgcctgagtcacatgttagtttaccaacattcaattgcaggatagaaacttccaggctatcagcggatcacagtttgtgtttgtgtttgtgtacgtctctgtgcaatgggatggcaagggagcctctgcttgataattatgagatgctaaccacataaaaaaacaagtctctttatagctatcctcaccactgggcctactattcagtgcattgtgcaaatgggacaccttagggtatacacttgggaacatatattcctaggagaatttacccaggaatatctgttctttccaaatataaacctgacttaagaggtaggcatggtgacacctctctgataagaagaaaaacaatattgctaggttggttcatccaaacttgtctcagtggcaggatccccatatagatagaacatagaaactcttacctctttagtgcttattaaaagacatgttgtctagacaaccattccttgaaaagtaaggacaatgtgggcaatgttgccactggagtattccataattaatgaaaacctgactggtgaaaacagacaggctgcctaaggtggaaagctaagtacaaagatttgaacggaatcttttcagggagatcccagttcttcaatggatttaaagagctgctctctaatgatatgtggggtgcaggatacccacatgatggagtcagcagaagcgatgtatctcagtttattttcaagttagcttactttaattttttttttaatttgaaaggtattagcctttttttctgatttattgaaaatattcttttctcatgccatatatcctgattatatattttccttccctctactcctccaagttcctccccagctcccatcttctccccatccactccctttctgcctctcattagataagaacaaggtttctaagagacaacacctatacagaacaacataaaatataataagatgaagcaaaaaccaccacagcaaagttggacaaggcaagtcaacagaaggagaagagcccccaagagaagggacaagagtcagagacccattcaggagtgccatgaaaattctcaggggaaggctacaaaatatacgtagaggaccctgtgcagatctgtgtaggccctggtgcttcagtctctgtttgctcacaggagccttacttagttggttcagaggaccttgttttcttggtgtcctctggcccctctagctctgagactccttctgtctcctctttcacagggatggatctctcagctctgagaggaaggatttgatgaagacataccactcagagctgtgtgtcctaaggactctgactctcccctctccgttctcctctctctactcttctccctctctctcccctcttctctttcttctctcctctctcatctctcctccctcccctccccactctgtaaaatgtctgagtgtgggtttctgcaaatacattttctttatcaagaaatgagcaacagaaaaacagtacccaatacttattattttgcttaaataaggctggctaaacatcaacatgcaacattgcatgttagaaaaaggggacagacaggattgagagtcagaaagagtaagtttatgtcccaggatatctattcactgtgtgatattagccacatttgaactctgagactcagttattgacttctttcatgaaaaaagggggaaaagagaggtgcaactaatggtcctgacctcaagttgccctccaagtgttgtcctaaaaagcattttgaaaaaaatgctgtattttcatttctaaggtgagatgttttcacagcatgttagacagcaggcagaaaaaaattatactgtattttagtagataatttatgtaaaaattattatataggtaataaaagagtcaacttctatgcataaatgttcataagatgactttaaatagcatgctgtattgtttgacagttgtcagacccgtgaagttgtaatgactattaggataaataaaacaggaatgtcaaaacagatgcatttctattaaaatggttacactttcccccaaaatcaacttttaaatcacagggtgtatgactcaactgtataaaaataccttcttcagaggtggggatctagctgccatctacaccccagatgcccagtactgtcagaagatgtgcacttttcaccccaggtgcctgctgttcagctttctcgccgtgactccacccaaagagacaaataaacggtaagatgtgatggtttgtcattgccaggttagatgttacttaaactgcttccagttatatgccaaaatagtgccatgtttctcagagtgttcaaagactctttgcatcagaagctcctaggctgggtcttttcaatgcagacccaaagtactgaacccagagacagactctaaacagccacaacacttgttcacagtgataggaggtagtgatgctacagccaaggcctgaagacagagcatgtgacaagaaagggtccttcctcacactgcaatacttagccttttttcactttcaacatgttattctgtccccacatgtacatctgttatgtatataaatgttattagctgggttatgcatatgagggagaacctgagggttttttttctttctgagattatatggcttcccttaatattaaaaatactaagtccatccattttcctacaatttttgtgatttcatttctcttcagcgcataatagcattgcattacatattttctgttttattcatttgtgtattaattaatttattataaatgctgcaaataaaacaatcacagaaccaaattaaccagactcagagactgtgcaactcagtgaacttctatccagttacagtaattgtttgaaaaggaagccagggaatgtcacaatgcacttgatactttcactatcaaatttatattttaatcatatatattgctttctaataaatggtgacaatttcacctgcatagagaaatatatttaattgctttactagctaccatatttatagggagcaaagttgagaaagtataagccaggaattttgttgataataaatttgagacccagtaggcaagtctcaatagtgcctgcagtggaccagtttacacttttagaatatgcattttctctctctctctctctctccctctctctctctccctctctctctctccctctctctctctctctctctctctctctctctctgtgtgtgtgtgtgtgtgtgtgtgtgtgtgtatgtgtgtgtgttttattaggtggtaattttggcaagaacaattattaaaaatatatttggaaattttaccttaattttctttcatttgatcaagagccaaatgtaaatttttgcttctttttccatacacataactttcatcttcaactatgtgaatttaagaattagaattttaaaactcattctctgatccctacatgctaatctgtaccaaaaaaaacccaaacaaacaaacaaacaaacaaaaaaacccagaccatatgtgagatttacatttttaaaaaaattgaaccaggttctaagattcttataaatagcaacgttaacatagcgttgatattgaagacagaaaaagcctcccattacatggacactaccgggaatcaatacaccagatgaacatcacatgcagacctaactcatagctgagtcagtttttttaaaagtaaattaaaatctttataacaataatcaccattttagaaaatgtggatgtttcagacaggagaatcgtaagtttaaagtcagcttgtgtaagttaacaagatcctttgtcaaagcaaactaagtaaaagcttggggtggcatggggggaggaaaaggctggtgataattattaggatttgattagcatatttgaagcccaggctctcctcctcagtaccacataaactaagaacaaaaccaatgatcttttggaaagaggagccagcgacgttcagaatgagaaaagaatcatcaacccttcagtgtggttggctctccgcacttgcagcgtaaacagtaagaaaaacaacgctatagagagcatggacttgtcgcaagaacgttctcttcagcaagtgacaaggccatgttattagtttcctgaccctgggctttatttattaacatgtacaaaatactgcatcatttcttaatgtgtgtttgttcaattccgcttttaaaatgtgtttttttaaaaaacaggtttggttgcttcatgaaagagagcattacagggactttgccaagaatacaccggacaggggccatttctggtcattctttaaagcagtgtggccatcaaataagtggtaagatgtggattttttttcccaactaaatttgagttaataacactcaaactcagagtagcttttgctgcaagtttatactatgatggacttttagacgagaccaccaagaaagataatagagctgaggcagcatcatggctgtaagaagggggtactttcaccttgataatgttcacatctttatcagttatagtgctcagccttaacgggcctctattacctatggtattcacacacaatgtaagatttgtgggaaatgaatatgcacccagataataggccttccctgtttccgcaacagactttttaggtaagactcggggacatctcatcccaaagtggattttggggtaattggtggtcacccccagaactgactttgccctctccatgtcaaagaacagctgaaaatgtctggagacagtttagattgttaaaattggggaaaatggtactttacggtaatgctcagagttggtgcagtcagactcagcagaaaacattctggccaccacggggccattgataagggattaagactgtggttctcagccttcctaatgctgcagctctttaatacagattctcttgtggtggaggttaccagctatacacttttcatcgccacctcataactgtaattttgctactctaataaatcatagttgtaaacatttgtgttttccaatggtcttaggcgacccctgtgaaagggtcttgcaacccctccaaaatgggttgtgacccacgggttgagcaatgccggtttaagaaatcttatttttgccactcggtccagactgaaagactgagttctgtccatcttgctaagcgtaatatttcttacaaggaatgtgaacgctaggatgttagagcgctttctctgtgactgctgttgcaactgatgtcttagaacacaccatcttaattctcagaccatcttaaaggcttaggataaagaaggcatttttataagatgacagggactgttagaaagtgaaagtgctaaaaaagaatgaggcggtgagttcgattatattgctttgtttttacgtccttcattccgtaggttcaaatttcaaatgttctcattttgctccagtaataataacagccctctcaccacataaacattcagtgtctgcagtttaaattttaggcaatgaatgaagaatgacaatggcttagctataaatccatatatttatatgtacatatatttaacctgaagtgaactacatcaagatcaatccataaactaacttgctgtatattgcttgatgaagtgtctaattactgtgaccaacgacaacattttaaaaaatagaactattgtgacttccccaaagctgcttagttgtctttttctccccctaactttgtaacttttttccaaatactttcaagaaagatcttcaagttaaaaagggatctcaaggagccagttttagtaaaaactattgagaggtgggcttaaagtgtacagataatcattaagaaaatattttatttgtttctaccttatcccaaccctcagctcatttcttttcttatctgaagcaaatttaaaagaaccttatttttacaatttacagtttcctaccctgtaaactgctgggagtttaggacccctacaccctaacataatgctttcctttttttttattggatagtttctttatttacatttcaaatgttataacctttcctggttccctcccccaccccaagtcccctatcccatccccctctctctgcttctattaggctactcccccacccacccacccactcccgcctccccacccaggcattctcctacactggggcatcaagccttcacaggaccaaaggcctttcctcccattgatgcctgacaaggccatcctctgctatatattcggctagagccatgggtccctccatgtgtactctttggttggtgatttagtccctgggagctctggggggtctggttggttgatattgttgttcttcctatggggttgcaaaccccttcagctcctttctattagtttgtatatgcatagtgtctcctgtgtttaattaatttcacaatttttagaaacttatagttatgtacaatagaatattgtttgtgctaacacacacacacacacacacacacacacacacactgcttgcttaactaagtatctaattaaaacaaaacgtaagagcttaatttggcttaatttctgttaaaagaatcaactattttcaatatataagataaattccagtaaaaggatgcttaaatagaattgaagaaacctttaaaaactggtgtgctagcacatggctatcatctcagtaccagggaagcagaggcaaagaacattttaagttcaaagccagtctggtctgaaattcgagattgccacattcagcatggcttgggggctggaaaactgagtaagaacattaagggaagaaaggacagacacacagacccatgtgcagggaagctggaatagtgtgagttatgagactgaacccctaacccccagaatgcttgttacatacacaggggaagggttaaatagtctcagagggcggtcaggcaatctctcctcttggtctataatcatcttggagtagaaggtgaagttgctggtcattgtgcacactggtcaattgctcctaaacactactgctgagacccagggatatctctgcccttttcccatgggtctgagccactgatccttcacatgtggtcctcagactacagaccacagacttcacctgctcctttcacatttactggggtttcccatggttaccacaggagttccaaaccagccaggctagaaaggacaaggaaggatgcagtggctgcggtggtggccagtggtggtggtggtggtggtcatagaacttaagagaggtttaaagcaagaagggaaatgatttcactgtgcgtataaataaattgagacagtctgttaaaagatttgacacaggcatcagtgttgtgactaatagtcacaaatagcaatcagacctgaataggcgaaggaagagaaactgatgcagatcatgattttgttttgttttgtttttttggttgtttgcattgttggtggtggttgttggtttgggtttttttttttgcgtatttgttttttgttttgtttttgacccagaagtcaaaggttcgccgtttgtcaaatactttgtgtctctggcacacactatcaggacccctgttgctgttgccttccttgcttatcagtgcctctgctagcttccatgtggaagtgcattgttttgtattgttgcatactcgttgcagtttaagaggcaaaataacctgtttttaatgctggggccaggtaaacacacccgaggtgagctaatgtccagcagtgtttgataatttagacatgcaaaaaacattttaattcctgtacttaccagggaagtcaccaaaatgggataccaaccttcaaaaatgactctgagggaagagcagtttatttgtgtctaaaaagaagtttggtcgaacgtctctgtgtttcctttcagcttgccaccgagacatatacaaaggacttgatatgagagggtccaactttaatatctctaagaccgacaatattgaagaatgccagaaactgtgcacaaataattttcactgccaatttttcacatatgctacaagtgcattttacagaccagagtaccggtgagtgaggcacagatccgagaggacactccagggatgtgttagcatgaaaaaaaaaatcttccctccagtcaaggtgcaaggggcatgcaatccccagccctgcccctattttattccttatttacatagttaatttcaatgtaatttcctcctaaaggtagcaaactccctgtagtcaactgataggctgtgtatgggcatagtgtcagacaatggtgtctgccactccattcgcagaagggaaaagcatctgttgattgatgttgcccaactgtgcccctctgtggttatcaattcgataacgaatattatccgcacgtctttgtgcgccccaacaaaggaagcataacaacatcttttgtgacatccaggaagaagtgcctgctgaagcacagtgcaagcggaacacccaccagcataaagtcagcggacaacctggtgtctggattctcactgaagtcctgtgcgctttcggagataggtaactagatgacgattattccactgtgattgcgatgccctaaacaagagtgccaagaaatacccacgtgccattcccagggacctggggaatatgatgcctttttatagatgtgattgcatggaaatacttggcaatcggaatgatgttgggttaccagaatatgcccctgcccaggctcaagggttcttatatgataaagagagaaacagaggggtcagtgtcagagtagaaagacttgaatggtctatattgctgcctttaaagatggaagaagagtccaaaagcaaagggtagcagaaattaaaaagggcacagaacaggtctccctgttaattatataaatatattatatttatcttccaaaggactataaaggcagaaaccacaacatgataattttgggaagccaaattcactcatatcctatttgggtgtgggcaaggcttgattttgcaatatacatccagcaggtgcctcagtcgtccaagcaagcaagcgtttcacacaaaatcggaacttagcaactagcctgttaaatctttgccccgttaccttgcaagaatagctgaggccgtggcatattttgtaacactcaggcaattttattttttgcccagctgtaccaggaagtggtccatcaatggacagggtacattcaatgtaagaacaacttcttcatggcttatatgagcttaaaggaacattttgtttttacaagccgagcagagtaaacgtatcctctaattatattgttcccaatcatcggaccttatgctgtgctgtagcgtggtagaaaatcacaggtcaatgtgcatgtgtggaagatacagagaacaaacagaggccttggtttagagcaacctgcccttgtggggtaactgacctagtccagtgagagcaggaacaggtattacccaattcacgtggaatgcaacttcacgactttgcactaggccatactgccaccttgggaagcaagcgtcaccaggatttttgctgcgggcaaagcacactccagccagaacagcacactgctgcaagggtgttttaaacacaggtttaaagacaaggtttttttttgttttgtttttgtttttttttttgtttttgttttttttctgcctcaagtgctgtccacagtctcaacaagtgaggtctgctagcattctgtctaaactccacccccacagttacctggcaacagccaggtaggctccttcctctcttaccctcttgggctctcccctactctccccccctccctactcccttccctcctctctccacatgctcatggctagactctacttctctactctcttcttctctctgcctttctctgcctctactactctcttaactctcccccccccccatgccctgaataaactctattctattctataccttctataccttcgtgtagctggtccccagggggaaaggctgccttggcatggacctgcagagatatccccttcccccacacttcaccatacccccatagaacatatcttaatatctctatatcttttttataatcacaacattggttaaaggcttgttttcagagtttaggcatggactttgaaagctttggagataatcatagttgccctgttaatggatcaatactatttacaattctaattaaaaggactcctcttttcctgttgtaggtttggcatttgccctgatctgtattttcatcttaggaggcagatgtcatgtcccataatcaccaggatccattgcttctccccaccttcccctctctctttttcccctcctatccctcctcctttgtaccccgtctccttctccctctccttcccctccctctctccccctcctcctctcttcctccccctttcccccttcccctctctcttcctccccctttccctctctccgtcccctcctcctccccctccgtctctcttttgtctttctccctcctttcttccttcttcctctttctgtagacacatgctctcaaggaaagggctggaaacactaggcaaaacaggagtcaggtctgataaacttaagccctgtgagcagaattttccagggagcttcttgacaaaccgagtgatgattgttgtctgggaacgagggacagtggctttggaggtgctccaaccattctgacatgttgattttcagcacatccatggggctgttttccaggtctctatggatctgagaaaggggcacaaatataaggcagttcaaccccacacagctcttgctgaaggtcagccatttgtttctatctcaggattagtctcaattgtgtgtccctttggttaatttctagggattaaaaaaaaagtgacttgactcattttactagtatttaacatagttataaaagaagacgaatgcaggctggtggtaacatttgcctttaatcccagtgttcaggaggtaaaggctgagttcaaggctagcccggtctacagagtgagttccagaacaaccagggctacacagagaaagcctatattgaaaacaaacaaacaaacaaacaaacaagatggattctgggcacttgtattctctcagcctcgctaacattctgtaacacttttaattaacagagtgacccacttagggttattgttgttgtgatgaaacaccataaccaaagcaactcagggaggaaaggtttagttcagtttatacttctggataacagtgaagaaagtccaggagggtgggacctcaaacagggcaagaacacggaggcaggagctgatgcagagggggtggaagaatgctgcttactgccttgctcatcatggcttgctcagcctgctttcttatagaacccaggaccaccagcctatggatggcactacctaccatggactgggcccaactctgatcactaattaagaaaatgccctataggcttgccttcagctggatcctatggaggcattgatgctccctcttctctgatgactctagcttctgtcaagttgacataaaaccagccaggtcatatagctaacaacctaacgttggagtggaaaatgtctttggaaagccagatgctcatcttgcctgggtcaggttctgcattttgtgtggaacaataggaagctggagtatagccaactagggcaaccatcttgacggaattcttagaagtaatggaaaatttagaaaccagtaaaggaagatgttaagtatattcaacttgaacagaagactgccttggcgtttggcgaagtctcctctgttctgaaaggctgtcattagggactgggtcagtacacaatcccgtagggttgttttagaaaggtaggactttgtagaaagtaattttttgaagtccctaacatcttcagcggtccagaaaagaagttgactttgtcacatggtggtgaactccttttcaactacaaatgtcccaggaaagttgtaaagtgacatgccagggatgtcttggagatacagttgtaggttggcatggttacctgaacattctcttccagtagcaaggctcttcatgatttttttttttaattcaagtggtagaatcagcttccaagactacacaagtgggatgtgagctctcttgatccaactgtcttgagtttgactggcctatcgttattcttaagtgtccattttattagtatggaatcaaattgattcttacatgctatcgaattgagcaactcatgtaaatagcataaataaaaatagatgaaaaataaaatgatataaggggggatgaaaatgaagcttttctgttctcatcgaagggcatgcttgttagccctttggaatttatgttaatgtcttttcattaaaatgcttctcacaatactcagaaacaaagcatgaaacagcatgttcccaaggcttagtcataatacaagggaaactcgagtcatctaatgtcctattagaaatgacagtgctgcttattctacagcacccagttgctgtctttcccagtagaacaacttttacttttttagcaaagaacaaactacaaattctgagataagttaacaggctttcctcctcttattgaaatggattctctctctctctctctctctctctctctctctctctctctctctctctctctcacacacacacacacacacacacacacacacacacacaatatatcctgatcccggtttccactcccattactcctcccacaacacctcccctccatttctatcattagaaaagaaacaggcttctaagtaataaaacaaggcaaaaatgaaacaagaaaacaaaaccgaacacattgaacttgaacaaattgaagaaacaaacgagagaaggcacaagattcagagagctacacacacgtccgcacactcaggaatccccattaaaaatagtcaagtggaagctatacccaggggacctcttgcagaccagtgcagccccagtgcatgctgcctcagtctctcaacgggcagtttttaacacagggtgctgattcccgccaatatcaattgtcataatcaccttagttactatgttgaaacaaacacaagcaaactcgggcattgtgtcactgaggaatgttcaccgctgagttcacaggttgccccatggatattttccagcactctgcctttgcagacctgaatgtaagccaggtcatcacccccgatgcctttgtgtgtcgcaccatctgcaccttccatcccaactgccttttcttcacgttctacacgaatgaatgggagacagaatcacagaggtgagtgtgagcggcgtgcgcccccttctagccctttccgttccttgcgagggtcttgctcgttgccctaacagcgctggagcctgtggtttaaccggatgcttttcagccaggtgcaggttacttcacagattaacaaattcttcccttccataaaacaagcctactatttagtcaaaccacagcggcagaggcagaagggagcaggaagcattctcactggcattaaggtttgggattggcttgggttacagctgctcatgcaaactgtcctttaatcttgtgagaaaccagagccctgcttatccagatctagggtctagtctgacctcttcatctttacacagcatttcctttatgtacgccgtggggcctgcagaaggatgtgtgtggacataataccatgggtagcataaatccaaaccaacagtcttttgatgccttctctttttcctttttctaattagaaggtggactttaatcctctgtcctcttttctggatgtctgtacctaccaggtattttttgccagagggagaggtgactctacttacatttaagccctgtgatatttttggagtcttgcagtctgactgactgaaaataatttctcagaagaataccatttatggagttgcttagagaggaaggaaggaaggaaggaaggaaggaaggaaggaaggaaggaaggaaggaaggaaggaaggaaagaaggaaggagagagagagagagagagagagagaaagagaaagagaaagaaagaaagaaagaaagaaagaaagaaagaaagaaagaaagaaagaaagaaaggaaggaaggaaggtaggtctgtctagtgcttctaatgctgtcttcttcttctttctcatttatttttaatagaaatgtttgttttcttaagacgtctaaaagtggaagaccaagtccccctattcctcaagaaaacgctatatctggatatagtctcctcacctgcagaaaaactcgccctggtaatgactcaatcttagtggcacatggcatgtgtccgggtttggttcttggttgcttgataaatactatgaccaaaagcaagttgggagagaaaggagtttgttttgttcacatgtcccagtcatagctgattcctgagggaagtcaggctagaaactcaagcagaagcagaggcagggactgggcagagaccatggagaaatgttgcttcttagcttgcttctgtgaatatatatatatatatatatatattcatgctacctgcccagaattgacactgacctggttagacggaccctcttccatccatcattaatccaaagaacatcccacagacatgcctataagttagtctgaggaagacgattctcagactgatggtccatcttttcaggtgactctattttgtatcaagttgacaaacactaacagccacatggtgcagcacatcttggggtcctctaagagttaatgaaatggttctcacgactctagaaactttgccaatgtgactcgtttcctgacttgtgatatatcctttgatatttgtgtatggtgcagaaccctgccattccaaaatttactctggagttgactttgaaggggaagaactgaatgtgaccttcgtgcaaggagcagatgtctgccaagagacttgtacaaagacaatccgctgccagttttttatttactccttactcccccaagactgcaaggaggaggggtaaggaaacctttctttgatgatcagcaaggtaattgttttctagttttctccctgtgtgggggtttaattttagactgttcatttatttccaggtgtaaatgttccttaaggttatccacagatggctccccaactaggatcacctatggcatgcaggggagctccggttattctctgagattgtgtaaacttgtggacagccctggtgagtgaggttcgtttgttacggaactgcatggctggcttggctgttgtgattaatgtcttggtcttatgtgatgggattgtttatatggtttctgttatggtttgtatatgggagtggcactatcagaaggtgtgaccctgttggagtaggtgtgtcactgtgggtgtgggctttaagaccctcatcctagctgtctggaagtcagtattctgctagcagccttcagattaaggtgtagaattctcagctcctcctgaaccaagtctgcctgcatgctgccatgttcccaccttgatgatagtggactgaacctctgaaacctgtaagccagccccaattaaaacttgtccttggtcatggtgtctgttcacagccgtgaaaccctaactaagacagtttccttggataaagggaaagaatgcttatctgtgtctaatcctgccacatctcaacacttttcagactgtacaacaaaaataaatgcacgtattgtgggaggaacaaacgcttctttaggggagtggccatggcaggtcagcctgcaagtgaagctggtatctcagacccatttgtgtggagggtccatcattggtcgccaatgggtactgacagctgcccattgctttgatgggtaagtttcagggtcatcttattataccaatgtgtgtgtgtgtgtgtgtgtgtgtgtgtgtgtgtgtgtgtgtgtgtgtgtgcatgtagaggttaatctcgggtatctacttgtactgcttgttcatcttatttgttgagatagggtaattcactgaacctagtgctaacctttttgactagacagataggtatctgcctgtctctgtctcctggtacatccttagccctagttctgggttggggatctgaacttgaatcctcaggtttgagaaccaagccctttgcccactctgccatctccttggccctgagatatttgtttttaggacaagaaaagtttcaaagtccttgcctagaaaatattataattttaaattcagcctgtatatcctttacgtggttaatttaaaattcaaaggaaaggtaggtagatttttaagcaacaaaatacctttaattcctgctggggcttattttaatcagtacagctacatgaaggctcggataatgagagcaactgtttttggggttggtagactgaacctgattctcccaaaggttcttcaaaaggcacagaagcactcctgtgctcttacttgaaataaacagaaagtaatttttaagtacgtcttgagtgtttccagccacagcgtttatactgtgaactgtaatcctttaggaacacagtgcaacagaatatgagcgtcttccaagattttagcaacagtaaagggtccctgaagggacactgataaaaatgaatccacaataaaaagtatgacaaacccgaggcattctgagagccctctcctgtgctgtgtctgaggattcctctgcagcctttgttcctgacacacaacatcatgcttactgtgcactgtgcatatcgccaggctgcgtagtaccagcagatggtaccctaaacccaatcaatcagactgaggattctttaatggtgtgaaactggtgtgtgtggtatgtgtgccttaggatttctgctcttacaggaacataacagtataattttaaacaatttaaaaaaaaacattaagatgtctcttgtcacagtgtgtctttggattgtacagtgttaaactctgattttcagtgttgctccagctggttagttgagtttcataaaaactcattgaatgaacttgggcttggatattagagtttccaaaactttctaaaccgtccttaatctaagactatcatttggttctccacatttatgtgaagtggtgcttctcagctttatcagttataaaagtaaaaaattaaggaactcctaaaaacattgaggttgttcttcgtcttttagtatgaaatacttagacatgttttaattatttatgtggaaataaacaagcccattattctattaatatgagcgtttgctaataagtggtaaaaattctccatacatcaaaaattgtcttgcagtaaatttctttataatatattaccagtaaatgtttaatatgtgtacctgcttcatatagtcacacacagagacataaaaataaaatcttttcaggcaaaagggagtcttaaatggaagaaagttttattacaaactaaatcttcaaagtccaatacgactgctgtaagcaatgacaggttgccttgccaggaaaaggtgactaggtcatatggaatgttgtctttcttttctctccaccccttcaagaaaatgtgctaagaaaaaggagcggaggaaggatgccaacgttactttgtttccctcctagaattccctatccagatgtgtggcgtatatatggcggaattcttagtctgtccgagattacgaaagaaacgccttcctcgagaataaaggagcttattattcatcaggaatacaaagtctcagaaggcaattatgatattgccttaataaagcttcagacgcccctgaattatactggtatgcagcatatttaagaggaacctgcacaactcaatggtattggtgtcaatttccacttcagtttgcatgagaagagagatctgcagcaattgtctttgtgtcctggttggtgaggctgagggagagatgaggccacctgggcagtagaaatcccgtgtcttcccatacattcactgctatctgaggggcaaaaaagcttcattactttctcagagtggcatgcaactgagtgtatggtattggtctaggaaagattttgacatctggggacattgggcatcttctgacaagattggcagaatgactatggcttaggaatatacaaccatatgaaagtgaacgggactagatgttagtgcccaagaataccctggttgacaatggggggacacggagcatggagctgctttggaggcacatcactccacaggaatggaatgtctgccaacaccattacctgcaagtgtctgtgaacagtcatgagaccttagacagcttggctttcctccttccacctctaatatctgctgcacgcgtgctgatctccgtgttgcttccttgcaatcattaagcaacgtattcaaataaagccctgggagagtatggctatttttgctctgtttctgaattctgctacagtgtatattaaacaagacataagaaagtagacatatgtttgccaataaattttggttgaagagtccctcttccccatagaaatttcgttccaaaatgccatacagaatgtgagaattgtcttgaattgtgggctttagaaattgctcagaaagctggagggtcgttctttttagttttagtaatgggtttcattatatttcatacatatgcatagtatgatgtaattgtattcacatccttcactctctcttgtcattttcactcctgcagttctccctgctcctcccaagtagtcccagactggtcattcttgctttgttgctttgtagaaaaagaataagagaaaaagatagatactaatttttgaagttcccatctatggtttcaattagtccaaatctattcatgaaattttctttcagaattccaaaaaccaatatgcctgccttccaaagctgacacaaatacaatttataccaactgttgggtgactggatggggctacacgaaggaacaaggtacagtatggcatgtgaaatgttcctgtcttacatgctaaagtacatagagtagatccactcaacaagccttactcatgacctttctgttcattccaaactattggtcctctgattcccaagaatgtgaatttttttacattaaacatcaatgagctaatcctttaagaatattactcataatagagattatttttatgagtctgcattaagaactgtggccctatgatactatcaagtccactgaatcccatgtggtcctcagtacttactgtgtccctgtttgctaagttctcccttggtatcaatagctaaggtgccagcatctctcttgaagaacagttcttaatatttatttaaatgccttcttgtaaaaaatctgacatttcctctaattatgccattaaatccttatgtaaaatacatagattcataaagagagaaaagtagattgcagtacagttaccaacatttgttaatagaattttacatagtgatgatcatatttgattattagtgtactcagttgcaaattgttttaaaatctaccataatgttgaagtagttatgggcataaacaacattttcctttctgtcgtaactacaattcaaagtatctgtgacccttacactacagtgctgccaacaatatcacattcctgcattagttatctgaacttaaaactgaagggcgtctgcagctttatttgaaaggttgagaatatagaggcgagtttttcgctttcccttccgctgagtgtatggatgcctcgattgtgtggctctgaactcaagacccctgtgtgctgagacttgagctatttctctagaaataagaatgctttctttctagactgagtgccagataaccagcattagacatatttgagtgattttttttaaaggagatgattggctgtgtcttctttatatttcctgaaccagtcagtactgtattcaattagttcccattttccactacatttacttggctacctatatgtggacacacacatatatacatgcatatacatacatacatacatacaaacatacatacaaacatctgagaaatatagacatgggtagacattaagttatctgtaaatgtatcatttattgcagaacaaaatactactctgctgtcagatgtttgggatgtattctcataaattgtacattttattataatttgaatttctaaaacaatgaaaggcaagaacatcctttaaaggtacaaatgtgtgagacaacattttttgaggggggcatcggttgatataggaggatgcctgagatcatagaaacaagtctgcagaggcttgggtgctagcgagtctgaaatatgtcactagaaggaaggcagcacggatcactgctccttcatctccttctcccccttctccttctccctctcccggtctctcttctccctccacctcttgcttcccttctccctccctttccctctgccctatttattgaacttcctctccttaaaggcacttcttgattgcttcataggtgaaacgcaaaatattctacaaaaggctactattcctttggtaccaaatgaagaatgccagaaaaaatacagagattatgttataaacaagcagatgatctgtgctggctacaaagaaggcggaacagacgcttgtaaggtaatggggaaaaaatacacaatagttccatgaagacagttcattcaaaaacgaatctccaaagttatatttcattagttttggttctgaagttccagagttaaacgatttgaaggctatttgaaacgatagcctttaacaaattaaacacacatagtgcatattatatgttacttataatagttatgctagaatatgtattgctgtgacaggtatgtcacagtgaggacaggggcatgccaaatttaaggacaatttttacatgccatggtcatgctaaaatacaagaaaagtagatttatttgaacttggagtaaagatgctaagtctgttgggtttatctgagaatgggagagggaataaattggccttgtaaccattcacttattttttttttcatggctaatgggatgcacagaaattgagaggctccgtggtggtgtgtaaagtgtgactgccaaatattaaagacatctgtctatgagcaaggggctccttatttgcatcatcaccattacccctctctacctttgtatttctctaccctctgtgacccagggagattccggtggccccttagtctgtaaacacagtggacggtggcagttggtgggtatcaccagctggggtgaaggctgcgcccgcaaggaccaaccaggagtctacaccaaagtttctgagtacatggactggatattggagaagacacagagcagtgatgtaagagctctggagacatcttcagcctgaggaggctgggtaccaaggaggaagaacccagctggctttaccacctgccctcaaggcaaactagagctccaggattctcggctgtaaaatgttgataatggtgtctacctcacatccgtatcattggattgaaaattcaagtgtagatatagttgctgaagacagcgttttgctcaagtgtgtttcctgccttgagtcacaggagctccaatgggagcattacaaagatcaccaagcttgttaggaaagagaatgatcaaagggttttattaggtaatgaaatgtctagatgtgatgcaattgaaaaaaagaccccagattctagcacagtccttgggaccattctcatgtaactgttgactctggacctcagcagatctcagagttacctgtccacttctgacatttgtttattagagcctgatgctattctttcaagtggagcaaaaaaaaaaaaaaaaaaaaaaaaaaaaaaaaaaaaaaaaaaaaaaaaaactgagaaagaggtagaaatctttgtaacatttcatttagaataaaaagagtctctacttgaacctgatgggacatctaaaccacctttctggccattgctgcagagttctgcatggtcatgactgcatgaggtttcctacccctggagcagagccatctgggcatgagggttgcttgtataaacttcatgttcctccctcaggaaataacctctctgcctaggttattgaggaatatcctctctgccaggacagcccttaagactgtgggaaagaactcttaaaacataagttcaagaatatataatttctcagctatgtaaaatataaggatacaatatgaattgtataaggagattcgattcgtggacctaaaagaacaaaggcagctgcactatgagccagcttgtcagaaagatactactgaaggagataaagagataaagagatttagggagtggtgataacagggcaagatcccagccagctaagtttattatttgtgcttacataggcaggcagagtcctgagttcaagatcagcctgggacagagctagtttagacccagggttggtgggaatcccacccagctagcttgttgtctatgctaagaaagacaggcagatctctgaattcatttggcatgttttttttttttaaaaaaagtacctgatgtcttttcttaagaatcaagaggctagagtcatggaatgctgactcatgggttaaacaaaagggaatctagagtaagtgactgagttgatatgtaaataaaagactgggctttagtctgcaagagctgagctacctggatgagctgtctggagatctctgtagagcagaatactagtctctaatttttttagattttttttttttctagtagctactcagagagaactgcttagagaatgaaatgaacattgctattttagttgtgttgttttgtttttttttttttctagaaaatccaaaaatattttatagaagcttctctgactctagtcagaaaacccatgagctagccagagagcttttggatttttttttcctagcaagagaaagctgtctcaagaagagacagctgtctcaagcaaaagagctgccttgagcagaaagctatctctatcagactgcatagccaagagctatctgcagaaagctgtccagctgtctagactacaaggctgtcagcttgcaacccatcatatgactttgagttgtttctttcaccgctcccagacaccccttctcgcaggaacctccctccaagccaaggctggtcctgggcaccttgccacatggtcttggctacagatgtgtgcaagacctgtaaggctatatttttcttcttgtgtgcagctcctgcaataggcctatcacacagtactcacacagggcaagggatctgatgagaacctcctggggaaccctcggggttcagctgatgctgtattctgcaatagtaattcatgtaatgtcattgggtgtaaagtgttgtataaaattcaagcttccaattgagttgaaagtgaaaagcaatcttggaatggatgacattaatcctcatgcaagacaaatttccagcttcccattgattcataaagtgggtcatctgtgcttaactccatttagttaacctggttaatatttagacagaattagccatttacgaactactgtgcaagttaaacagacaaatagaaaagtgaaatttcctaaagaagattaaacttttccttgcatatataaaggcttgttgagtagtgcagagggttaaatatggaagatcctgtgggttatctacagagttcaccatgggaagtgtaagaggtggaagcaaatggctttggaaaaatcttccaagcacacaacttcaacttttaattttgtacaccatttcatcttaatctgtgtggcagttgttttatatttaaaaagaaagaagtggttctcaatgaaaatcttgtatctcaaggtttcatattaataaccctaacaggtatttacacaaggtgtcacagtacttactgggtaaactttgggctttggtttctcaaggaatggcctcatttgagcaaaacagagttttgaaatgagggatttccctatggcgtaaagtaccatgatcacgttgccagctggagtccagctgggctggaatgctctgcttttcattgtgtgttcctgcacaaagtagcccgtcttccactcgaagccttaagaggctgagaaaatgagagggccggataacatcacttttacaagacaaagtggaggcaggaggccctagatctttggcaggtccatccaagaaagggagtgtcacctctggaatggaacaatgccggcactgttcttcctgggccgcacgtggagagcacacagcacaccactaacacttctagagctcaacgggaagctcaaagggctgtctgatctctatctattttttttcttgtagttcttgcttatggctaccagccctacaaactgtcaacaactctgaaggatgctcttgcatctctgcctctctctttcatcagtacttcatgtgaataggaatgtggcaaataggagagatttgggtttgctgttattatttttgttgctgtg

SEQ ID NO: 14 - DNA, 2513 bp, Rattus norvegicus
tgaagactagcttcatgtgaagactccttctcctccagcagcacaaagcaaccatccttccaggatgattttattcaaacaagtgggttattttgtttccttgttcgctacagtttcctgtgggtgtctgtcacaactgtatgcaaataccttcttcagaggtggggatctggctgccatctacaccccggatgcccagcactgtcagaagatgtgcacgtttcaccccaggtgcctgctcttcagcttccttgccgtgagtccaaccaaggagacagataaaaggtttgggtgcttcatgaaagagagcattacagggactttgccaagaatacaccggacaggggccatttctggtcattctttaaaacagtgtggccatcaattaagtgcttgccaccaagacatatacgaaggactggatatgagagggtccaactttaatatatctaagaccgacagtattgaagaatgccagaaactgtgcacaaataatattcactgccaatttttcacatatgctacaaaagcatttcacagaccagagtacaggaagagttgcctgctgaagcgcagttcaagtggaacgcccaccagtataaagccagtggacaacctggtgtctggattctcactgaagtcctgtgctctctcagagatcggttgccccatggatattttccagcactttgcctttgcagacctgaatgtaagccatgtcgtcacccccgatgccttcgtgtgtcgcaccgtttgcaccttccatcccaactgcctcttcttcacattctacacgaatgagtgggagacggaatcacagaggaatgtttgttttcttaagacatctaaaagtggaagaccaagtccccctattattcaagaaaatgctgtatctggatacagtctcttcacctgcagaaaagctcgccctgaaccctgccatttcaagatttactctggagttgccttcgaaggggaagaactgaacgcgaccttcgtgcagggagcagatgcgtgccaagagacttgtacaaagaccatccgctgtcagttttttacttactcattgcttccccaagactgcaaggcagaggggtgtaaatgttccttaaggttatccacggatggctctccaactaggatcacctatgaggcacaggggagctctggttattctctgagactgtgtaaagttgtggagagctctgactgtacgacaaaaataaatgcacgtattgtgggaggaacaaactcttctttaggagagtggccatggcaggtcagcctgcaagtaaagttggtttctcagaatcatatgtgtggagggtccatcattggacgccaatggatactgacggctgcccattgctttgatgggattccctatccagacgtgtggcgtatatatggcgggattcttaatctgtcagagattacaaacaaaacgcctttctcaagtataaaggagcttattattcatcagaaatacaaaatgtcagaaggcagttacgatattgccttaataaagcttcagacaccgttgaattatactgaattccaaaaaccaatatgcctgccttccaaagctgacacaaatacaatttataccaactgctgggtgactggatggggctacacaaaggaacgaggtgagacccaaaatattctacaaaaggcaactattcccttggtaccaaatgaagaatgccagaaaaaatatagagattatgttataaccaagcagatgatctgtgctggctacaaagaaggtggaatagatgcttgtaagggagattccggtggccccttagtttgcaaacatagtggaaggtggcagttggtgggtatcaccagctggggcgaaggctgtgcccgcaaggagcaaccaggagtctacaccaaagttgctgagtacattgactggatattggagaagatacagagcagcaaggaaagagctctggagacatctccagcatgaggaggctgggtactgatggggaagagcccagctggcaccagctttaccacctgccctcaagtcctactagagctccagagttctcttctgcaaaatgtcgatagtggtgtctacctcgcatccttaccataggattaaaagtccaaatgtagacacagttgctaaagacagcgccatgctcaagcgtgcttcctgccttgagcaacaggaacgccaatgagaactatccaaagattaccaagcctgtttggaaataaaatggtcaaaggatttttattaggtagtgaaattaggtagttgtccttggaaccattctcatgtaactgttgactctggacctcagcagatcacagttaccttctgtccacttctgacatttgtgtactggaacctgatgctgttcttccacttggagcaaagaactgagaaacctggttctatccattgggaaaaagagatctttgtaacatttcctttacaataaaaagatgttctacttggacttgaaaaaaaaaaaaaaaaaaaaaaaaaa

SEQ ID NO: 15 - DNA, 30000 bp, Rattus norvegicus
attcctccagcccctgtatcacgtcaaactcgaaactccagctccaggactagctgcaggcattgatgcttctgcgctgtttccattctgtgatcatgtcttctccatacctacctctaagttttccatgaggtctcaaagtaaaagctttaagaagaaaaaaaaagtgttgtccagcaggtttcagtaagctttgctggagaggaccagataataaaatcttagtttgcttgtttgttttgttgttgttactgaagaccgttctataatcataggaagtaggcaggcatacatcgtgcagcagtgaatggacatggttgtgttccattaaaacttcagctagaaggacaaatcccaagcaagatttgttctgtaaacagtggattattaactcagtactgggtggatctgaacatgaacttccagtgtaataaaaaggtagaaaagcagaagtgtgaagaatcccgagagctcaggggagaccactgcttctgctcacattcctggcccaagaggactccccctggagacctctggacacaagaaccgaggagcagtctggttcctgcctgtacccagaactgacactgtaacacatctacacagtggagtattactcagctattaaaaacaatgacttcatgaaatttataggcaaatggatggaagtagaaaatatcgtgagtgaggtcacccaatcacaaaagacccacacggtatgccctcactgataagtggatattagcccaaaagctcggattacccaagatacaatccacagaccacaggaagctcaagaagaaggaccaccaaagatgcagatgcttcagtccttcttagaagggggacaaaaatattcataggagaagataaggagacaaagtttggagcagagactcaatgaatggtcattcagagctgccccacctggtgatccagcccacatgcatacagccaccaaacccagacagtatttctcatgccaagaaatgcatgctgacaggagcctgatatagttgtctccagagagactttgccagctcatgacaaaaacagaagagaatgtttgcagccaatcattgaactgaaaccagggtccctgttggaggagttagtgaaaagattgatgcaaccccgtaagaacaacaataccaaccaaccagagctcccagggactaaactaacttccaaagagtactcatgaacaggccaatgtctccagctgtatgtatgtagcacaggatggcctttctgggcaccagaggaagaagcccctggtcctgccaaggctggaccctcccccagtgtaggggaatgtcaagatggagaggtgggaagaggtaggtttttgggttgggaaaaggtgataacatttgaaatgtaaattttaaaaatccaatttaaaaaaggtagaaaaccaataccttgctttgattctcctataggagctgtctaccccacccccacattgaggtgtgcctccaggaaatttcaatagaagtatacacacacacacacacacacacacacacacacacacacacacacacacttgtaaaggcaaataggtaagaatcaagctgttagtccccaaataaagagatatgaccattttcaaaatgggagacctatgcctgaattgtgtgtccctagtataaagcacttctctttcttcagcataagcacttaaacgcatttcccatgtataatttatttaaaatgggttcttgatatgcttgtaatataatgatatcttggtatacatgaacactgtaacattatttccactctaaagttacttaacacagtcaccatctcagacaattattatgtatgttacgaatacctgcataccagggtacagtgtgtacacctataatccagcactctgaagatctagattcagtggttctcaacctggggagaggggtcacatatcagatatttacaattcataaaagcagcaaaattacaattatgacgtagcaacaaaatacctttatggttggggatcactatacatgaggaactatattaagtcgcagcttagaaaggttgagaactactgctctataggatgcaaagacagctcaggggtgctcttgaagagaacccaagctcagttcccagcaaccacatcaggtggctcacaaggacctgtgtctccagctccaggggacctgattccctctgtcggtctgcaacgtgcatgcatttgcagtgaaagagacacatcattagaaataaaataaatggttaaaatttaactaatgttgctattgctgggcatgggatcttgcagtctattagttctaaaagctgaaattttgtatcctttcacaaacaccacccatgacaccaagtttcagatcctgacactcaccatcccacttgtttctagggcttgcctttttcaaatgccacatgtaagtatagctcttcaaatggccatatgtttttatatctccaccagttttgcatcactgcaatccaataccttgagcccctatgtcgaatttataatctgcccatcagttgactttaatttatttagggttgcttataagttcctaatttttttcttttggtgattttgtttttcttttctgattatttgtgatcttctggctttgtgttggtgtttgcacttttagataagaggctattttaaatttaatttttaaaaatttatttattcacccattgcaaggctatgtgtgtgtgttctgtgcaggttctggggattggactcaggtcatcaggcttgatggcaaatgcttttgacctactgagatgtcttgtaagctccacgatgattttagacttttaaagcttgcttcactgggcaaacctagtagtcatgtatctcatcaatggattctgggttagccaactgtgtagttagagttggatatgcaaggctaggtttgaatcttgggtccacagaaaagagcattgcatcagggtccaccgtgattacattgatgactgaattcctagagcccatgcttgaatcctcagatcagtggggccacgatcttatgattgaggactgccttaacatgttgatattgaaatgaacctgaaaactgagcctccagtggccatgttaacgaactcaagcccgtgggcatgggtttgttcctgaatctacaatcgctgtcctggaaatgagccctggaaatgggacaatctggtggctggcctgaggtatcatcctggagcctgggtctgcagggtcagcctgataactgggatttcctggaatggacttgtttacatctgtctttattcatagggaacacatcgccattctgtgctgcccaggcttagtagcagggttttatggttaaagtgaaggatcgaacactcttcaatgcctattcactatgtccacagtttcaccgggggctgtaacctatcatctggctttcttaacacttggaaaggcatggggaattgttcccatggattcttctgcaaagggatgcgtggtggagattccaattttgtcatggtgtttacatgactttctggaatcggtaacatattaagtacttgaacctggactggaaggtccatggactgtattgacaggtcaaacagaagacactgatgccagaagcccagtgtcaacactggagccaagcagagaccaacctcagtgccatattcggagagcttgaagactagcttcatgtgaagactccttctcctccagcagcacaaagcaaccatccttccaggtagctactctccaccattctcattgtagcctatgtcttaggaatttatttttttaaaaaagtataactatatctgcatgaaaaagtctattggtgtaatgcactaatttcctgagggtttagaaaatctacaaggaattgtttttctttgtacagctatattaatgtaaaatattttaaagccaaggataagcttttgattcttttcaaagatgctctttatgtgggggttgtgggtgatattattgtactcattcataataattttgcataaatctagaaatttaataagtgtttaattatttgtatcaactctctttacaaaattaatagaaataattcttcaaaattaacaataaatacactaatacacactaattgtagtctagaggtctcaatttgtatcttggggagcatgataaatattttaattttctatatccaaaatgtcccctcctccaaatcctctttctcctggtgattatgtgttgtgatttgcaatttagacatttaccaaaaaggtgaagtgtacattaaattaaattgtctattaaatacatggtaaacatgatctcaacctagtagtagctaaatttatttttttctttcaaaggatgattttattcaaacaagtgggttattttgtttccttgttcgctacagtttcctgtggtaagtattagcctgggagttcaaattaagttagtgtgtgaaactataccactcctggagaaagcctttaaaagctttggggaagaaggcagctgctgatagtccaaggcaagaacctctccttagatacattactcctgacacagaacggggtggggggggaacttagaagcttcaatgcttctgctagcagaaatttctgtatcaagatttctctctagcagagtcctcccaccccaaagatttgcttgtgtttattaccagccctctaaataaaaactctacctgaaaatcggaaagaatatcagatattgcataatgattgagtccaatccaagcttctgattagtatatggtatttttaatataaggcatagagagccatttctgaactgaaaacacctgctttggatttaatgagtgtagtaaccctttggtagtgtggatggacagctttaacactagatgtcagtgttctttctctgtgaattccattacggttcagaatgtgagcatggccctggacacccccttctcaatagtcattatagagtgagatttccctgggcatatcatagtattccgatcaaagctgactttgtctagccacacctcaagggctgatcttgactctcaagtatttggcaaagatgagcttatccttgtcaatagaagccatttctctgggtaaactcattgttttccctctctgctccctccatctggcccatcaactgtaactgcttttctgtgccacaactactgccatgatcaaaccaattaaacacgagcagtggtagtcagagatgctatgggccatggctataaaatttacgatcatgacaggaacgtgagacatggaaatacatttaatacttgagaacaagtactttacatagtcctaaagtacaaaataatgattgcttgcttttctttagtctttcttatttttctgcatgaatctgttgtataaaagtgttattcgtgaataataattttaatgagaaattatgactattaatgacaaatcatttttgacttacctttgctatttatagctaatgttaacacaaacaagcacttttgtcattcgttcttcttcacgctattctgtatgcatgtgacattctatgcacacattcaattatttctactgattcaaattttagaaataaaaatttttagatacaaacatgtgaatacctttgaaggttttatggcatgcattatggtattagcttccagaaaggcatcctctgtttggttttccctacgagcatgtgggagtgttcaaccatcccagttagagtgagccctaacaggcatctgttactttgtagtctggcgtaggatcaccgttctaaaatagcatccagatttcttcctgaggaaccatctccaacggatggcccacatggtactggagatgattctcctgctgcagtcagaccagaactgcagacagtgctggtgtgatgacctgaccagagctagtcttgtaacaggctttttctcagacttagaaaaaggctcagatttatttttatttccaactcaacttgagctgctggtcctgccttactagtgtgcatcttgagatgaaggcagcatcacacaatagagtaaatcaacgctgacacactgtgcatggatgccattcctgagcagtgtctagtgctccataagccattggctgtggacacatgggtttctgaactgttaaactcatttatattcaaactgctctgattgattttcttttatttgtgaacaaagccagcacacaaatattgtttcaagtttaatctttgttaacctggctgtttaacccagtgttctgagtctgagactcttacattttgtttttttaacataaaatgtatttaatattgacatatcatttctaagagattatattgttaattcagaaaaagaatgtgttatctacattcttaaaatatcataaagatttagacaatgatttcttttttagaaagttatctaaattatcactaatatgaaatatcaggtggaatatcgtgtatttgtttttctagtttagaaagaattaatctgtagcttgtatgtattgactttgtgaatgatgatagtttttaaatgtttttaattgacactaggattataccacccctttcctccctctagtttctcctaggaacacttccttgagcttctcccatgttcccctcactctgaagctgattgcctctcttttcatttagtattaatgctacatatgtacatatgtacacagagatgtatgaatgcaacttgttgagtccatttttgtttgtgggtatatggtttgtgtgtgcttgtgcatattgaacaactagtaagtgggctcagctctggaaaaggttaattctctttctccaaaaggtcattagctgcctatagttctttgtctaaggtggggccccatgaaattcccccttccatgttactacatccattgatattgccatcgttctggtcccttctgggagggactgtttcacagcaaacttcctgatattctggctatcattacctttctgtgttctctttcatgatatccctcgagccataggtttgggatatgagatgtagatatatcgactggggctgggagccccacagtatgttgacctccgcattgtgtccagttgtggatttttgtgatggtgtctgtcttagttagggttttactgctgtgaacagacaccatgaccaagataagtcttataaaggacagcatttaattggggctggcttacacattcagaggttcagcccattatcatcaaggcaggaacatggtagtgtccaaggcaggcgttgttcaggcagagctgagagttctgtcttcatctgaaagctactagcagaatgctgagttccaggcagttaggatgagggtcttaaagcccacacccacagtggcacatctactccaacagggccacaccttcgaatcatgctaatccctgagttgagcaaatacaaaccatcagtgtccatttgctaccaagagaggcttctttgatgagagagagtagctacctttatctaggaagggtggctcctgcactgttagcagcttttatacacatatagttacttttattaattcggtaaattatcttttcatatctgatgctgaattttaaaagttttagcatttatttatttttactctatatctgcacatgcgtatacatatatacacatgtgctgtggagcacatgtggagatgagaggacaacatgtggaggctcagttttctctctgccactcacctagagttttgagttaagatgcttcatttatctatggaatttttccttttctttctttttgattatgtacatttttaatatgactaaataactcagtcatggtccatggacctgcagtttattgaaagacatcattatagatcaattaggtcatacagactctgtgcaaacaaggctgtcattgttctaatcattactgctcaccatcgttatcattgctgccatcatcaactgaggaggataatccattctccagttagaatgtttcgactcattcattctcattgactgagtcacgtgttagtttaccaacactcaactgcaggatagaaacttctaggctgccactcgatgatggtttgtgattttgtatgtgtctgtgcaatgggatagtgagggagtctctgctcaataattatgagatgctaacacattaaaaaaaaaagcaagtctctttatagctactgtcagcactgggcctgctactcagtgtgttgtgcaaatgggacagcctgggttgtacacttgggaacatatattcctaggagcaattacccaggaaaatctcctctttccaaatataaatctgacttaagaaggtaggcatggcaacacccctctgataagaagaaaaacagtattgcaaggttgcctcatccaaattggactcagtggcaggatctccatataagtagaacatagaaactcttaactttccggttcttattgaaaaacgtattgtctagatagctattccttaacaaacaatggcaacatggacaacactgccactggagtattgcataattaatgaaaacttgactgctgaaaatggacaggctgcctgttggaaagctaagtaaaatgatttgaactgaatcttttcagggaaatccgaattcttcaatggatttaaagacagttctctaatgatatatggggtgcaggatacccacataatggagttgtgagtcagcacaagcagtgtatcttattttcaagttagcttactttcatttttgtaataatttgaaaattatttagcctttccccattatattgaaaatagagtcttttctcatgcaatatattctgattatgacttcccctcttcttccccttccagttccacccccacctcccatcttctcctggtctaatccctttctgcctctcattagataagaacaaaacttctaagagatagcaatcagacacaacaaaataaaatataataaaacagaaaccatcacatgaaagttgtacaaggcaacccaacagaaggaaaagagcctaagagaaggcacaagaatcggagacccattcaggagtcccataaaaatactcagctgaaagctataaaatatatgtagaggaccctgtgcagacctgtctaggccctggttcttcagtctctgctcatatgagcctgacttagtggaatcacaggactttgttttcttggtgtcctccatcccctctaggtcttagagtctttctccctcctctttcacaggaatccctcagctctgaggggagggatttgatggagacacaccatcagagctatgtgtcctaaggactctgactcttccttctcttcccctccccccatctctctctctctctctctctctctctctctctctctctgtgtgtgtgtgtgtgtgtgtgtgtgtgtgtgtgtaatgtctgaatgtgggtctctacaaatacaattttattaagaaatgagctagtaggaaatcagtactcaatatttattattttatttaagtaaggctgggtaaacagcatcatgggacagcacctgctgtgctggaaaaaaggacagaaaaggattgtgagtcaggaaggatgagtttatgtccgaggatatttattcactgtgtggtactaatgacatctgaactctgagactcagttattgacttccttcatggaaaaaaaaaaggaaaaaacaaaaaaaaagaaatgcaaataatagtcctgacctcaagtcgcccttaaagcgctgaggaatctagggagattgttgtcctaaaagcgttttgaaaaaatgctgtatttccatttttaaggtgagatgtttccccagcctgttagacagcaggcagaaaaaatatattttaacagatactttatgtaaaattatataggcaataaaaattttattgcataaatttattcaattttatgcataaatgtccataggatgactttatttattttttttttttacgccccgcgggggcccataggatgactttaaatagcgtgctgtattgtttaaacagttgtcatatgtttcattctacctgtgtggttgtatatatctttgggtagtcattgggataaataaaaaggaaaaacaacatagatgtatttctactaaaatggttacactttctccggaatcaacttttatatcacagggtgtctgtcacaactgtatgcaaataccttcttcagaggtggggatctggctgccatctacaccccggatgcccagcactgtcagaagatgtgcacgtttcaccccaggtgcctgctcttcagcttccttgccgtgagtccaaccaaggagacagataaaaggtaagatgtccgtgagtccaaccaaggagacagataaaaggtaagatgtccgtgagtccaatcaaggagacagataaaaggtaagatgtgctgttttatcactgccgggtgagacgtttctcaaatagcttcctgtcgtatgcaaaattggtgtcatagttctcagagtgttcacagactgattgcatcagaagctcctaggctgggttttctccaatgcaaactactagagtgctgaacccagagacggagattctaaacgaccacggcatttgttcacacagcataggagggagtgatgcttcagccaaggcctgaagacagagcgtgtaacaagaacgggtccttcctcacgctgtaatacttagctttcttcttcactttcaacacgctatactgtccccacgtgtacacttgttatgtgtataaatatgttattagtcaggttctgcatctgagggagaacatgagttttttcctttctgagattatgtggcttcacttaatatcacacattctaagtccatccattttcatacagtttttgtgatttgatttttcttcagcactaaatagcattcctttatatattttctgttttattcatgatttattatgcattaattataatttactacaaatgctacaaatgaaacaatcacacacccaaattaaccagatccagagactgtacaattcagggaccttctatccagttacagtagtcatttgaaaaggaagcatggaacttcgcaaggattctatactttatcaaatatatatatatatatatatattttaatcatatatatatattgcttgctgatagaaggtgaaaatttcacctgcataaagaaatatatttgttttacttgttaccgtatttatggggagcaaagttgaagatgtacaaaccaggaattttgttgataatagatttgaaatccagcaggcaagcctcaatggtatatgtagtgagcctctctctctctctctctctctctctctctctctctctctctctctctgtgtatgtgcatgcatgtgcatgtatgcatgtgcgtgtatcattaagtggtaattttggcaaggacaaatattagaaatatagttcggaattttaccttaattttctttcatttgatcaatagtcaaatgtaaatttttgccttccattttcatacacattacttttatcttcggtctatctgaatttaagaattagaaatttgaaactcattctctgatctctacatgcttacctgtacaaaacaaaataaaacaacaaaaacaaaaccaaaacccagactgtatgtgtgattcactttttttaaaacttgaactaggtcctaggattcttataaagagtaaagttaacaccgagctgatattgaagattgaaaaaacctccccttatatggaaactaccagatcaataaaccagatgaatatcacatacagacccaacttagctgattcaaattttttaaagtaaattacaatatttataaaaataatcaccattttagaaaacgtagaagtttcagacaggagaatcattggttttaaaatcagcttgtgtaagttaacaagatcttttctcaaaatagactaaataaaagctggcagtggaatgggaagaacgaggctgttgagtgattagcacttgatgaacatatctgaagcccaggctttcctcctcagtcccacataaaccaaaaccaaaaccgattatcttctggaaagaggagctatgaaataatcctcaactctgggatgtgggtggccttctgcactcgaagcatgaacactaagaaaaccaacgattgtagatagtatgaacttgtcttaagaatgtcctttccagcacatgtcgagaaatgtaattagtttcctgaccttattttatttattaacatatccaaaatgctgtataatttcttaatgtgtatttgtcgttttattccccttttaaaatgtgatttttttttaaaccaggtttgggtgcttcatgaaagagagcattacagggactttgccaagaatacaccggacaggggccatttctggtcattctttaaaacagtgtggccatcaattaagtggtaagatgtggattttttttccaactaaatttatgttactagcactcaaactcagagtagtttttgctgaaagtctatactatgatggacttttagaagagaacaccgagaaagataacagacggagcagcatcatggacctaaggaggggtctttcttcctgataatgttcatgtctttatcagttgtaatgcacggccttaaagggcttccattatctatagtactcacacacaatgtaagatttgtgggaaatgaatgtgtagtccagataataggtcttctgttccatagcagacatttcagataagattcaggacacatctcaccccaaagtgaaccctggagagtaagtcattgtcaccaccagaactgattgtgccctttccacatcaaacaacagttggtattctctggggacaatttaggtggttacaactgggagagatggtactctatggtaatggccaaggttggtgcagtcagacacaacaacaacaaaaaaagttctgaaaagttctggcccccactagggtcattgagaagggtttaagatagtggctctcaactgtccttacgctgcagctctttctcttgttgtggtggctcccaaccataaactatttacatcaccatttcataactataattttgctactcttatgaatcataattataaatatttgtgttttccagtggtcttaggcaactcctgtgaaagggtctttcaatccccccaaaaggggtcatgacccacaggttcagaaatgctggcttaagagatcttgtttgtcactcagtccagactgcaggactgagttctgtcaatcttgctaagcatactatttcttgcaaggggtgtaaatgcaaggatgttagagagctttctctcaggccaccattgtaactgatgtcctaggaaacaacatcctaatttccacaccatcttaaaggcttaatacaaagagggcgttttaataaaacgatgggggctgttagaaagtgaaagtgctaacaaagaatgagttgggttgtatcgtttagctttgtttttaacgtcattcattccgtaggctcaaatttcaaatgttctcattttgccccaataacaacaaccctctcaccacatatacagtcagagtctgaaacttaagctttagggagttaatgaagggtgacaatggcttagttataaatactgcttcactggtgtaatatcttctctatcttataagatcaaacccatataccaatataacttgctgcatattatttgatgaaatgttgtgtctaattattgtgaccaacaacaaaatataaaaaaatagaaacattatgccttttccaaagctgcttagttgtcacatgccccctcccccctagcttaaccttcttcactgagtttggctctaaagtttatttgcaactttctcccaaatacctttgagaaagatcttcaagttaaaaaatgtttgcaggaaccaattttagtaaaaactattgagaggcaggcttaatatttacagataatcattaaaaatatgttttatttgtaactacttcatcccaatcctcagttcatttcctttcttatctgaagcaaatttaaaagaaccccatttttatgatttacaattttctgccctgtaaactgctgggagcttagcacccctacaccctaacataatgctttttcaattagtttatatatacagtctgtctcctgtgtttaaattaatttcacaattcttagaaacttatagttatgtacaatagaatattgtttgtgctaacacacacacacacacacacacacacacacactgcttgcttaactaagaatctaattatgttgtcttaaaaacaaaacctaagagcttaatttggcttgatttctgttaaaagaatcaactatttttaacatgtaagataaacttcaatgaagggatattttaaataaactgaagaaacgttttaaaactggcgtgctagtgcatggctataatcccagcactagggaagcaggggcaaagaacattttaagttcaaagccagcctgatctgaagtgggagattaccacatccagcatggcttgggtcctggaaaactgagaggaacatcaagagaataagaaaggacagacacagagacccctgtccagagaagctagaacagtgtgagctttgagcactgaacctccaatccccagagtgcttattagacacagcacagtggaggggttaactagtcacagaggggtgtctccctcttggtctctcctcttggtctgtaatcatcttggagtagaaggtgacgtcacggtacacactggtcaatagttcctaaacactgttgctgagacccagggaaggctttgccgaagtcccatggggctgagccattggtccttcacatggctacggacttcaaactacagatttcacctgctcctttcacagttactcagggcttcccatggttaccacaggagttccaagccagccagttttgaaaggacaagaaagggttcggtggctgcggtggtggtggtagtggtgatggtggttaatagaatttaagaaagttttaaagcaagaaggaaaatgatttcattgtgcatataaataaattgagataatctgttaaagattcgacacagatatcagtgttgtgactaacagtcacaaatcacaatcagacctgaatagatgaaggaagagaaatagatgcagatcgtgattttgttgatttgtctgtttttttgtttcgttgttgttgggttttggtttggggtttttgtttgtttgtttttgactcagaagtcaaaggctcgatatttgtcaattactttgcgtctctgtcacacactatcaggacggttgctttcttggtttatcaatacctctgatagccttcttctgaaactgtattgttctgaattgttgcatatcccttgcagtttaagaagcagaataacctgtgtttaatgcaaaggtcaggttaagcacacctgcggtgagctaatgtctagcagcacttgataatttagacacgtgataaacattttaattcctgtacttaccagggtggtcacaaaaatgggatactagccttcaaaatgactccgagggctgagcagtttatctgtgtccaatatacatatattataatacatatatatacatatatgtatgtatatatatatggtcgaatgtctctctgtgtttcatttcagcttgccaccaagacatatacgaaggactggatatgagagggtccaactttaatatatctaagaccgacagtattgaagaatgccagaaactgtgcacaaataatattcactgccaatttttcacatatgctacaaaagcatttcacagaccagagtacaggtgagtgagtcatggttccctgagaggacattccaggatgcatcagcatccgcagtgaaaaagacaagtctgcttccctccagtcaaagacaaggggtgggcagtcctgagccccttccttccttaaatttcttagttacatacttaatttcagtggaatttcctcccagagatagtgaacttcgtttagtgactggtaagctatgtatgggcataatgtcagacaatgatgtccgccactccatttgcagccgcctgtcccctttgcagaagggaaaagtgtctattgatcactaatggcccaactgtgcccctttgtggtaacaaatattatctgcacacctttgcacacctcaaggaaggaagcataacatcttttgttgacactcaggaagagttgcctgctgaagcgcagttcaagtggaacgcccaccagtataaagccagtggacaacctggtgtctggattctcactgaagtcctgtgctctctcagagatcggtaattagatgacgattattcctctgtgtctgtgatgtcctaaggaagggttcccagaaacatccacatgctgttccccgggacccaggaatatgatgcctttttatagatgtgattacgtggaaatagtttgcaatcagagttatttgggattaccagaatatgtgcctatccactctcaggggttcttagatgataaagcgggtaacagagaggtcagtgtcagaggtagatagacttgaaaggtggaacaagagtccgaaagccaaaggggtaccagtggtctgtagacattgaaaaggacatagaacagaggaacagaagcaagccaacctttgactggcacccaggaagacttgctttggccttccagcctctaggaaaggtgataaatttctgttgctgtaacctctagttttactataatatgcctacaacaacatcattagaagaggaagctccaccataaagaaaaccacaagatcattctgtggtatccgtatccagagaaatatgcacattgtcgtgaatcaaccaagccctgtaacttcacacacagaggtagcgctaaatgaattacccggacagttgccttcaaatttaggacaccaaggtgtcagtggtgagatttactgagaccagtccacttatagtaaatagtaccaatactgaatgctggccctacaccaggccctgtgttaggtttccgaattctgtggtatgacctctgtctgaaagactgagaagtcagaagcaacatagctctttccctatttgtgttttcttttctctatgtgtccccaccaggctgtgccattcagatggcttaaatatattaactatttaattttaatattccccttttctagtttttggaaacttgtctataggagatagggctctttattcaacagtgttcccttttgtatactgcgcttatcttagactgcaccctgcagctatagccagatgccagaggactgggaaacaggcaatttaaaactcaggatgctgactgctgcaaataccaattgtcataatcaccttagtttctatgttgaaaagcaagcaaactccacatcgtgtcactgagaaatgttcaccactgagttcacaggttgccccatggatattttccagcactttgcctttgcagacctgaatgtaagccatgtcgtcacccccgatgccttcgtgtgtcgcaccgtttgcaccttccatcccaactgcctcttcttcacattctacacgaatgagtgggagacggaatcacagaggtgagtgtcagcagcatatgctcccttcttagccttttccggtcctagcagaggcttgcaagggtcttgctggtttccctaacagcgctggagcctgtggtttaacaggatgcttttcagacgggtgcaggttacttcgcagattagcagattcatcctcacactttccttcttccataaaacaaacgcgctattcactcagaccacagtggcaggggcaaagggagcaggcagcgttctcactggcattaaggttgaggattggcttgggtaacagctgctcatgcaatccatcctttaatcttgtgagaaatccgagccctgcttaccctgatctagggtctagtctgacctcttcatctttacacaacacttcctttatgtataccctggggccggcaaaaggatgcgtgtggacgtaataccgcaggcagcataaatccaaaccaacagtcctttgatgccttctctttttctttttctaattagaaggtggactttaatcctctgtcctcttctctggctgtctgtacttactaggttttttttttttttttttttttttttgccggagggagaggtggctccatttacatttaagccctgtgatattttggagtcttgttgtctgactgactgaagagaatttctcagaatacaatttacagagttgctttaaaaagaaaggaagaaagaaagaaggtaagtaggtaggtaggaaggaaggaaggaaagaaggaaggaaggaaggaaagaaggaaggaagggtgggtcttagtcagggtttctattcctgcacaaaacatcatgaccaggaagcaagttgaggaggaaaggaattattcagcttacacatccacatcgctgttcatcaccaaaggaagtcaggactggaactcacacagggcaggaggcaggagctgatgcagaggccatggagggatgttacttactggcttgcttcccctggcttgttcagcttgctctcttatagaacccaagaccaccagcccagggacggcaccacccacaatgggctgggtccttcccccttgatcactggttgagaaaatgccttacagctgggtctcatggaggcatttcctcaagggagtctcctttctctgtgataactccagcttgtgtcaagctgacacacaaaaccaatctgtacaggaaggaaggaaggaaagaaagaatatgtctagtgcttctaatgctgtcttctttctctttcttgtttatttttaataggaatgtttgttttcttaagacatctaaaagtggaagaccaagtccccctattattcaagaaaatgctgtatctggatacagtctcttcacctgcagaaaagctcgccctggtaatgtcactcaacctcgatggcgtgtgacttgtgtcctggtttggttcttggttgctgtaataaataccatgaccaaaagcaagttggggaggagagaggtgttttgttcacatgtccctgttatagccgattcctgagggaagtcaggctaggaactcaagcagaggcaaagacaggaactgagcatagacctcagagaaatgctgcctttttgacttgctcctgtgattgatcatatatgtgtatgtgtatgtatgtgtatgtgtgtgtttgtgtgtgtatgtgtatatgatgtgtagatgacgtatgtatatgtgtatgagtttgtgtgtgtgtttgtgtatatgatgtgtagatgacgtatgtatatgtgtatatgtgtacgtgtttgtgtgtgtatgtgtatatgatgtgtagatgtatgtatatgtgtatgtgtttgtatgtgtgtttgtgtgtgtatgtgtatatgtataggttgtagatgtataagtatacgatgtatatgatgtatgcatcatgtgcatatgatgtgtgtgtgtgtgtgtgtgtgtgtgtatcagtagcccatgaccacctgcccagagtggatactgccccccagttggctgaccctcttctttccatcattaatccaaagaacatcccatagacattcctttaagttagcctgagggaggcaattcttcaagggatgttccatcttttcaggtgactcttttatgtcaagttgacaaacactaggtgtaccacatcttgggagcctctaagagttaatgaaatgggtctcaagtccctagaaacgttgccaatatgccttatgtcctgacttgtcatatctcctttggtgtttgtatgtggtgcagaaccctgccatttcaagatttactctggagttgccttcgaaggggaagaactgaacgcgaccttcgtgcagggagcagatgcgtgccaagagacttgtacaaagaccatccgctgtcagttttttacttactcattgcttccccaagactgcaaggcagaggggtaagggaacctttctttaacgataatcagcaaggtaatttttttctagttttctctctctgtgggtttaattttgtactgttcatttttttccaggtgtaaatgttccttaaggttatccacggatggctctccaactaggatcacctatgaggcacaggggagctctggttattctctgagactgtgtaaagttgtggagagctctggtgagtgaagctcacttgttatggaactgcatggctggcttgactgctgtgatgaatgtcttggtcttatataatgggattgtttatatggtttctgttatggtttgtatgtgcttggcccagggtgtggccctgttggagtaacttgttggagtgggtgtgtcactgtgggtatgggctataagaccctcatgctagctgcctggaagtcagtattctgctagcagccttcagatgaaggcaccatgcatgcctggatgccgccatgttcccatcttggcgataatggactgaacctttaaacctctaaaccagctccaattaaatgttgtctttataagagttgccttggtcatggtgtctgttcgcacagtaaaaaccctaactaagacagtttccttggataaagggagggaatgctgatctgtgtctaattctgccacacatctcaacacttttcagactgtacgacaaaaataaatgcacgtattgtgggaggaacaaactcttctttaggagagtggccatggcaggtcagcctgcaagtaaagttggtttctcagaatcatatgtgtggagggtccatcattggacgccaatggatactgacggctgcccattgctttgatgggtaagttttcgatccatcttattttaccaatgtgtgtgtgtgtgtgtgtgtgtgtgtgtgtgtgtgtgtgtgtgtgtgtgtgagcatgcacgtgtatggacccttacctgcacatgtgtatataaagaggttagcctcaggtatcttcgtgtactgcttgcttttcttatttgttgagacagggttgttcactgagtctagtgctaacccttttgactagactggctgcacagccagtcccagagatctgtctgcctctgtctcccggcacattcttagccctagttcagtgttggggctctgaacttgaatgttcatgtttgagaagcaagccctttgcccacttagccatctccttggccctgaggcatttgttttgatgataataaaagtttccaagcctttgtctagaaaatattatgattttaaatttagcttatatatcttttacatggtcaatttaaaattcaaaagatatgtaggtacattttaagcaacaaaataaccttaattcctactggggcttattttaatcgttacagctgcttgatggctctgatgtaatgaaagcaattgcttttaggtctggtaaactgaacttaattctcctaaagcttcttcaaaaggcacagaagcattcccgtatttttacttgtaataaatataaagcaattgttaagtttgttttgagtattttcaaccacagcttttatactgtgctctgtaatcctatatggacacagttcagctgaatatgagcccctcaaagattttagaaacagtaaagggatcctgaaggaacactgaccaaaattcaatcaaaataaaatgttatgacaaacctgaggcattctgagaatcctctcctgtgcatatttcaggactccactgggtttgtaaacatacaacatgcttactgtgcactgtgcatgccaccatgctgtgtagtaccaacagatggtaccctaaagacaatcagactgaagattatgtaatgttgtgaaccatggtgtctgtagtacgtgtgccttaggttttctgctcttacaaaacataagagtttaatttcaaagaacaaaagcattaaaatgtgtcttgtcacagtcgcctttgggttgtacagtgttaaactttgattttcaacattgtttcataaaaactcattgaatgaacttgggtttgggtattagagtttccaaagctttctaaatggtccttaatctaagactatcatttggtcctccatatgtatgtgaagtggtgttcttagcattatcagttataaaagtaaaatattaagaaactcttaaaagcattgaggatgttctttgtcttatagtatcaaatattcagacatattttaattatgtatgtcgacataaataaacacgttattctattaagatgtgcatttgctgataagtggtaaaattatctgtgcaccaaaaattgtcttgtagtaagtttctttataatatatcatcagtaaatgtttaatatgtgtgcctgcttcatgtaatcacacacaaaaacaaaaaattatcttttcaggcaaaagggagtctcacatggacaaagttttattataaactaaatcttcgaagtccaatactgctgctgtaaacaacaataggtggccttgccagaaaaagtaactaggtcatatggaatgttttcgttcttctccctcctccccttcaaagaaatgtgctaagaaaaaggagcaaggaaggatgccaacgttactttgttctcctgcttctctcctaggattccctatccagacgtgtggcgtatatatggcgggattcttaatctgtcagagattacaaacaaaacgcctttctcaagtataaaggagcttattattcatcagaaatacaaaatgtcagaaggcagttacgatattgccttaataaagcttcagacaccgttgaattatactggtatgcagcgtatttaaggggaaactgtacaattcacttgtattggcgttagcttccagttcaatttgagcgagaagacagatctgcagcaattgtctttgtgtcctggttggtggggctgagggagagatgaggctgcctgggaagtaaaaaccccacgacctaccatgcatttgctgctacttaagggggcaaaagagcttcattactttctcagagtgcaacggagtgtatggtattgaaacagttggtatagggaagattttgacatctggggacattgggtatcttttgacaagattggcaggatgactcttgcttgggcttaggaatatacaactatatgaacatgaatgggactagaggttagtgcctaagaagacactgggctgacagtggaggaacatgaagaatggaactgccattggtggcacatcactccacagaaacagaatgcctgccaataccattagctgcaagtgtctgctaacagtcatgtgtccttagacagctcgcctttcttccttccacctctaatatccactgtatgtgtgctgactacttcattgctttcttgcaataattaagcaagatattcaagtaaaataccaggacagcatggctatgtttgctctgcttctgaattctgttacagtgtaggtttaccaaagcataaggatgtttaccaatacattttggttgaagagtccctcttccccatggaaatttcattctgaaatgccattcaaactgtgagaatttccttgaatcatgggctttagaaatggctggagggccattctttatactctttagtttcagcaatggtttcattatatctcatacatgggcatggtatgttttgattgcatgcacccccttcaccctctcttgcccttcccactcctgttgttcgccctactcctcccgtgtagtcccacatggctcattcttgctctgttgctttgtagaaaaagaataaggcaaaagatagatattaatttttcagatccctatctatggttttaattagcctaaatctattcatgaaattttctttcagaattccaaaaaccaatatgcctgccttccaaagctgacacaaatacaatttataccaactgctgggtgactggatggggctacacaaaggaacgaggtaagcctggcatgtggaatgttcctctcttatgtgctaaggtacatggagtagagccactcaacaacccgtagtcatgatccttctgtagatccattcaacagcccttactcatggcctttctgttcattccaaaatgatcccaagaatatgacttttttgcattaaaaactgatgagctaatccattaaacatattactcataatagagatcattttcatgactctgcatcaagaactgtaaccctatggtgctcttaagtccactgaagctcatctgatccccagttctcacagcatccctgtttactatgctctcccttgctatgaatagccaaagtgccagcatctctttaaggacagtgccatatatatatatatattatagtatagtagtgccaaatatatatatttgtagtataataaatctaactttccctctaattatgctgttaacttcttgtgtaaaatacatagattcataaagacaagtagattgcagcacaattgccattatttttagcagaatttcacacagggataaacatacatctgtattaatgtaatccttagcaagttgtttgaatatctaccataatgtttaaataactatgcacaagaacaatatcttcctttctgttgtaactacaattcaaagaatccgtgactcttacacagcagtgctggtgacaatatcacacttccgtatttgttatctgcatttgaaacagagggtggggttcagccttacttggaagggagagactgtagaggccagtttttctccttcccttcctcggagtttatggatagatcagttgtatgcgtggctctcaaatcaagggatctgtgtgttaagacttgagacatttctctagaaataagcatgttttccttttagactgagtgccagatagcatgtttgagtgatttttttaaaaaaagagatgattggctgtgtcttctttatattttctgaaccagttagtactgtattcaattaatcctcattttcactatgttgacttggctacaaatacgtggacacacacatatacatgtgtgcacatgcacacacatacacacacatacatatacacacatacatacatacaaccaagaaatatagaaatgggtgtagaacaaaatacttctctgctgttaaatgtttgggatttattttcataaattgtatatttgtgttataatttgaatttataaaacaatgaaaggcaagagcatccacgtattaaaggtacaaatgtttaaaacaacatatttttctgaggagagccttggttgatacaggaggatggctgagatcatagaaaccaagtctgtggtagcttgggtgataggggagcttcagtcaacacagatcattgcttcttcatctccatctccctcccctgctctccctccacttcttgcttcctttctccctccctctttctcccctacttattgtatttcctctctttaatgctacttcctgattgcttcataggtgagacccaaaatattctacaaaaggcaactattcccttggtaccaaatgaagaatgccagaaaaaatatagagattatgttataaccaagcagatgatctgtgctggctacaaagaaggtggaatagatgcttgtaaggtaactctgggaaaaatacgtaatagttcactggagactgctcatccaaaagcaaatttcccaagttacatttcattagtttcagttttgaagttgcagagttaagtgacatggagacttttttttttttaaagatttatttttatttatgtgagtgtacactgtcactgttttcaccagaagagggcatcggattccattacagatggttgtgagccaccatgtggttgctgggaattgaactcagaacctctggaagagcagtcagtgctcttagctgctgagccatctctctagccccagacctggagactttttaaacagcctttaacaaactaaacacacacaatgcacatcatgtgttccttataatagttacgttagaatttgtattgactgtgacgggtgtgtcacagtcagtacagggacatgccatatttaaggacaattttacatacatggtcatgctaaaatacaaggaaacagatttatttgaactttgggtaaagatgctaaaattgttgggtttatctgagaacgggagagggaataaattggccttgtaaccatccacttactttcttcatggctaatggggtgcagagaaattgagaagttgcatgtgtgatatgtaaaatatgatagcaaaatgttaaagacatctatctttgaacaaggggctcctaatttgaatcatcactgttatagctctctatcattttttttctactcactgtgatccagggagattccggtggccccttagtttgcaaacatagtggaaggtggcagttggtgggtatcaccagctggggcgaaggctgtgcccgcaaggagcaaccaggagtctacaccaaagttgctgagtacattgactggatattggagaagatacagagcagcaaggaaagagctctggagacatctccagcatgaggaggctgggtactgatggggaagagcccagctggcaccagctttaccacctgccctcaagtcctactagagctccagagttctcttctgcaaaatgtcgatagtggtgtctacctcgcatccttaccataggattaaaagtccaaatgtagacacagttgctaaagacagcgccatgctcaagcgtgcttcctgccttgagcaacaggaacgccaatgagaactatccaaagattaccaagcctgtttggaaataaaatggtcaaaggatttttattaggtagtgaaattaggtagttgtccttggaaccattctcatgtaactgttgactctggacctcagcagatcacagttaccttctgtccacttctgacatttgtgtactggaacctgatgctgttcttccacttggagcaaagaactgagaaacctggttctatccattgggaaaaagagatctttgtaacatttcctttacaataaaaagatgttctacttggacttgatgggacagagcaccttttcatataaaccacctttctggccattgctgctgagtcctgcatggtcatgagtaaggagctcgtgacagggtttcccacccctggagcaaaaccagctagatgttaggcttgtttgtataaatttcaagttcctcctttgggaagtattctctctgcctagattattgggggaatatcctctctgtcagggcagcccttaagattgtgggaaacatgagaatatataatttctctacaatgcaaaatataaggatacagtctgaattatataaggagatccatggacctaagagaacagaggcagctacactatgagccagcttgtcagaaagatactactgaaggagttaaagagataaagagatttggggaatagctatcacagggcaagatcccacccagctaagtttattatttgtgtttacaaagacagccagattcctgagttcaaggtcatcctgggacagagctggtttaggcccagggtaatgggggtcccactcagctagcttattgtctatgcttttaaatgcaggcagatttctgaattcatttgccatgttaaaaaaaatgtacctgatgtcttttcctaagatatacgggtctagagtcatggaatgctgattcatgggttaatcaaaagggaacctagagtaaacgcctgtactgatagatacataaaagtctgggctttggtctacaaatgttgagctatgtggatgagctgtgtagagctaaagattgaacagtggtctctaattatttttttagattatttttttctagcagctacccagagagaacggcttagagagtaaatattgctattttagatttttttttctagaaaatccaagaatttttatagcagcttttctgacactggtcagaaaacccatgagctatccagaaagcttttagatttttttttttcaagagagaactgtctcaagtagagacagctctctcaatcagagagagctgcctggagcagaaagctatctcgatcagactacagagccaagagctatttacaaagagctgtctagggagccattttaagcaggctataaggctgtcagcttgcaccccatcatttgactttgagttgtttctttcaccactctcaaacaccccttctctcaggaactcctctccaagccaagactggttcttggcacattgccacatggtcttggctacgtatgcatgtaagacctgtagggctatatttttcttcttgtgtgcagctccaacaataggcttatcacacagtactcatacagggcacggaatctgatgagaatctcccccagggaaccctttggagttcggttgatactgtattctgcaatagtaattcatggaatgtcattggatgtaaagtgttgtataaaattcaggcttgtagttgagttgaaagtaaaaagcaatcttggaagggatgacagtaatcctcatgtaagacaaatttccagcttcccagtgattcataaagtggaccatatgggcttaactccatttagttaagctgattaatatttagaattagccatttacaaactattgtgcaagttaaatagacaaacagaaaagtgaaatttcctaaagaagattaaacctttcactgcaaaggtttgttgagtagtgcagaggattaaatatggaaaagccagtgggttatccacagaatttgccacgggaagtggaggaggtggttattatctgaggagcaaataaatggcttttgtaaaatctgtctggattcccatgaaatcactcccctttaaagcacaccacttcaacttttaattttgtatacaatttcatcttaatctgttctgtgtggaagttattttatatttaaaatgaaagaagtggttctcaatgaaaatcacgtatctcaggatttcatactgataaccctaacaggtgttcacacaaggtgtcagagtgctggctgggtagaccttgggctttggtttctcaaggaatggcctcatttgatctaaacagttttgaaatgtttaatttccctggggcataaagtaacattataacattgccagtgggagtccagttagattggaaggctctgtttattttttgttgtgtgttccagcacaaagtagcctgtcttccacttggggccttatggggctagtgagaaagtgagaggcttgaataacatcactgtcacaaggcagagaggaggcaggaggccctagatctttggcaggtccatccaaaaaagggagtgttatctctgggaaagaacacggttcttcctgggtcacacatgcagaacacactgcatactgttcacatgtgtggagttcaacccaaagctcagagggctgtctctcatcgttgacttttcttcttgtaattcttgcttatgcctgccagccctatagattgtcagtaactaggaaggaggttctccctgactctgtctctctctttcatcaatactacatgtgaatgagcatgtggcacatgtctccctttagatttacctttattatctttgttgatgtgttgtttaattgtatgtcacgtggttgctagtgcctgacaccaactgatcaaagcgtaacttctgagcaactgccttctaccagagtaaaatagagtagtccttcatgtcaagatctcttcaaagtcatacacaggcacacacacatggacacacatgcaggaaagcatggacacacatacacatacacatgcatacacacgtgttgtagttaccattattttgagtgtttactataccccctttttgcctttaactatttattaggtatttctaccctactttagataatttagttcccaaataaaagacacaggaatctttggatttagaataaactttagagcactgggcagatatcaaccctctatgctatcttgtctgtttccctatcaaattgctggagatactactt

SEQ ID NO: 16 - skipped

SEQ ID NO: 17 - DNA, 2353 bp, Macaca mulatta
ggaagccgttcactagtcagattgaccagagattatgggtgggctgtctgttggggtctatgcacaggatttctgttggagttctaaggacaaaaagttgaaactgttggcagaaacccaaagtcaatatcgaagccaaggaaaacattgcctgcggtgccacattagaacagcttgaagaccgttcatttttaagtgacaagagactcacctccaagaagcaattgtgtttgcagaatgattttattcaagcaagcaacttatttcatttccttgtttgctacagtttcctgtggatgtctgactcaactatatgaaaacgccttcttcagaggtggggatgtagcttccatgtacaccccgaacgcccagcactgccagatgatgtgcacattccacccaaggtgtttgctattcagttttcttccagcaagttccatcaatgacatggagaaaaggtttggctgcttcttgaaagatagtgttacaggaaccttgccaaaagtacgtcgagcaggtgcaatttctggacattccttaaagcagtgtggtcatcaaataagtgcttgccaccgagacatttataaaggaattgatatgagaggagtcaattttaatgtatctaaggttagcagtgttgaagaatgccaaaaaaggtgcaccaataacattcgctgccaatttttttcatatgccacacaaacatttcacaatgcagagtaccggaacacttgcctcttaaagcacagtcccggaggaacgcctaccactataaaggtgctgaataacgtggaatctggattctcactgaagccctgtgccctttcagaaattggttgtcacatgaacatcttccagcatcttgccttctcggatgtggatgttgccagagttctcgccccagatgcttttgtgtgtcgaaccatctgcacctatcatcccagctgcctcttctttacgttctatacgaatgcatggaagatcgagtcacaaaggcgagtatgcatggctagcacttgctgctgtactttcatcaattttattttagaaactttacctgaaccctgccattctaaaatttacccgggagttgactttggaggagaagaattgaatgtgactttcgttaaaggagtgaatgtttgccaagagacttgtacaaagatgattcgctgtcagtttttcacttactctttactcccagaagactgtaaggaggagaagtgtaagtgtttcttaagattatcttcggatggttctccaactaggattacatatgggacacaagggagctctggttactctttgagattgtgtaacactggggacagctctgtctgcacaacaaaaacaagctcacgcattgttggaggaacaaactcttcttggggagagtggccctggcaagtgagcctgcaggtgaagctgatggctcagaggcacctgtgtggagggtcactcataggacaccagtgggtcctcactgctgcccactgctttgatgggcttcccttaccggatgtttggcgcatttatagtggcattttaaatctgtcagacattacaaaagaaacacctttctcacaaataaaagagatcattattcaccaaaactatagaatctcagaagggaatcatgatatcgccttaataaaactccaggctcctttgaattacactgaattccaaaaaccaatatgcctaccttccaaaggtgacacaaacacaatttataccaactgttgggtaactggatggggcttctcgaaggaaaaaggtgaaatccaagatattctacaaaaggtaaatattcctttggtaacaaatgaagaatgccagaaaagatatcaagattataaaataacccaacggatggtctgtgctggctataaagaagggggaaaagatgcttgtaagggagattcagggggtcccttagcttgcaaacacaatggaatgtggcgtttggtgggcatcaccagctggggcgaaggctgtgcccgcagggagcaacctggtgtctacaccaaagtcgctgagtacatggactggattttagagaaaacacagagcagtgatggaaacgctcggatgcaggcgccagcatgaggagcagcccagagtcttggcgagttttacaacctgggttcaagtcaaattctgagcctgggggtcctcatctgcaaagcatggagagtggcatctactttgcatcctgtcataaggacaaaagacagtgcactcagagctgctgaggacaatgttttgctgaagccagctttcagcattcagtaactgggagctgataatgtgaagtcgcaaccgagatctccatgattgtgtgtcgtaaaat

SEQ ID NO: 18 - DNA, 33001 bp, Macaca mulatta
  misc_feature (17364)..(18312): n is a, c, g, or t
  misc_feature (23228)..(23609): n is a, c, g, or t
actgttggaaagacatcattggttttgaaatctgaaaaggacgtgagatttgggaaaggccaggggaagaatgatatagtttggctccatgtccccacccaaacctcatcttgaattgtaatccctgcatgttgaaggaggggcctggtgggaggtgataggatcattggggtggtttcccctgtgctgtgttctcatgatagtgagggatttaaaagtagctgtttcccctgcacatgcacactctgtctctcctatcaccttgtgaagaaggtgtctgcttcccctctgccttccatcatgattataagtttcctgaggcctccccagccatgggtaaccgtgggtcagttcaacctcttttgtttataaattgcccagtctcaggtagtatctttacagcaatgtgaaactgaactaatacatctgggaaattctttttctctccttcctttctgaaggacagctttgcctgatattatattcctggttgccaggttttgtactttcagtactttgaatatatcatcccattctctcagcctacatgatttctgctgagaaatccactgataatcttatgaagcttcccttgtatgtgaagaattgcttttctcttgcttctttgaaaattctctctttgtcatggtgaggatctctttatatttaatctattggagttcttttgggcttcataaatctggatgtttatttcatttatgtctccaaattttgagagttttctgttcttatttttaaaaataagtttctgcaactttctctttctctgcttcttctggaactcttgtcatgcatattagttttcttaacagtgtcctgtaatttttgtcagctttctgcaatctttatcattccttttattactctgactgggtaatttcaaatgacctgtatctgagtgtgctgatcctttctcctgcttgatcaagtctgctgctgaagatgtttgtgaattttttcaattcagtcattgtgttcttcagttcgagaatttctgtttggttctttttatggttcctatctatctttttgttgaacttctaattttgctcatgtattattttcctgattttgtttactgtctatctatattgttttgtagctcactgagctttcttaagataattatttttaactctttgtcatgcagtatagatctccatttctttagagtcgcctcctgctgctttattttcttcctttggtggtttcttgtttccctgattatttgtgatcagtgtggccttgcattgaagtaggtacctatttcagtctttacatactagcttcagtagaggaagccgttcactagtcagattgaccagagattatgggtgggctgtctgttggggtctatgcacaggatttctgttggagttctaaggtaggcagggctggattctgggttcattcattgtggttgtctgtattctgtgcacaaggactggcttgaagcatggatccttgagggctgacttggcactgaaatgagccttaagcctgagtctgcaggggccagcctaacatggggatcacctagcacctgagttcatggggacagacctgttcctgagtttattcaggctgtcctgggaccagggtccactggggtgagcccagcatctgggtccacatggccaagatctctggaggctgacctggtgctggatctgcaggggatggcctgaattctaggcccatgggtaccaacttggagccttgggctgctggggctaatgtggaggctagagtcttgggggccaggctagagctggggcaggtctgaagtctaggtcttctgtggccaccttggagtctagacccccaggggctgacctggtctggggtgagcatggggctgaggccacagaggccagtctggcctgtggcaggcctgaatcctggtgccggggtttactggagtgggcttggtgcttggggtctgtggtgaaggtgggtgctatcttaactgtctctcttccacgcaagagggtatctctctccatgctgtgctgcccaggcttgaaggtggggtgacactggtaatgtgaaattgtccttcctatgcacttcaatgtgtcttttcttacttctgtgctgcaactgggtggtacaacctctcacctgattcctgagctctagtgaagttattttcgtgcatggatacttattcaaattgatgtttctgcaagggatgagcactagaaactcctgttctgacaaactcctattccggttcttgctgacatcactccctgaaatagttaatatacttaacagctgaacacggataggatgttcacggaatatgttgacaggacaaaaagttgaaactgttggcagaaacccaaagtcaatatcgaagccaaggaaaacattgcctgcggtgccacattagaacagcttgaagaccgttcatttttaagtgacaagagactcacctccaagaagcaattgtgtttgcaggtagcaaatttctattattctgattgtttccaaagaaactataatttttaaagtatagttttttactttatgagaaaattagtcatttatattctaatttcctgagtatatagatagtagagaaggaactaatattcctttatgtagaaatatttaaatgtaagatgactttaaatcaaaaagaatacttgattgatttaaaatttttaattgggctttaatattttcagaggttttctttacttagggatttttggactgacattattgccattatttattaattttctttttgctcaaatcaagaggtttcataactgtttaatctctctctctaccaattccctttccaacattactagccacagagtttgccaatcaacaataaacacaacagtagtctggaggtctcaatttgtatcttgggaagcattataaactttccaactccctagacacaaatgtagagaaaaaaccccttgttttctataccagaaactgtgtgctttgtcttgtaattcagacatttacaagaaaatctgtatcaccttaaattaagatttatgttaaatgcagtctaaaaccaacagagttatgtattgttttcttttttagaatgattttattcaagcaagcaacttatttcatttccttgtttgctacagtttcctgtggtaagtgaattatctataaagcatgaaattcaggctaagacaggagtagccaagcaagtcgcaccacctctggagaaagctattgaacatacagcttcggggatggagatagtccctgatgattcaggacacgtgtctatttaatgttccagaacaagtacgacttgtgagatatattgctgtatacatacattgcagaccagaggaaggagctcagaagcgggaatgtcttgggacttgtgttaataaaaacttctgttcacagatgacactctgcaaaacaaaactcaaaacaaaaaaattactcctctatttttatcaacattaaaaaattaaacattatctgaaatttcaaaagagtgctgggcattatatagtgtctgggtccaatccaagtatctgttaggtacatgatacatagttttactctggacagccagggaaccatttcaaaaatgaaagtacctggtttaaatttaacttagcaaaccaggcatttggatagttctaggtgaataactttcaacactagatttcgatctcatttctctattaatatcattaatttttggagaataaaaatgattctggacatttcattaatcgctatagagggagttttctctgtgtccccacaaggcatgattctgagtctatggtgacttaagagggccacataacaatgagtatttaactttcctctcgtatggctacaataaacgtctacagggaaggtttacattcataaagagactacttttccaggaaaaaaggctttgattccccctaaatcacaactcccctgtgtctgtccctcaaccctgattgcttttctaaaccgtaatttaccaacccatgtgcaaacccactgaaaactgaaaaggagcatgagccagggatactgtgaaccacggccacctccaggtggtttctcattttctgtttttttcttctggcaaaataaatcatgattatggctaggaaaattaaggatgtaaataagcaaaaaactataaactacatattgcatgtagtccccaaattcagaagcagtcgttgttaaacatcttttgtttagtctttcagatatttttctacatatgcctatttgcacattttacaaaaaagagttattaactatggatactctttgacttgcattttccacttacagctaccttttggtgcaaataaatgacattttttggagcttgctattctctttttatggtatgtttgtgtgcacattcttatgcacttagttatttctgtagaatacattttttgaaataaaaatactagattcaaaggtatgaatattttagaaggttttatggtgtggcatcatgaaattatctttcagaaaagttactccctagttgacttcttctaccagctaataagagtccttatttaccccacttaggccaacactaacaggcttctgttgctttgcatcccgacatgtttatctttctggaaacagtatcctaatttatttctgcagagctactgcctctcagttttggtccatgtggttctggtgaccctgactcttctgctgaaccaggaagtgcacacatcctgctgactgcagtgacccaatcagagccaacatcttgcaatgaagcgtttgtttagacgtctagaaataggactcttacttttttttttccaatttaacttgaaacataagagaatacagaggcctgagctgctggtcctattttgctactatgtggagcttgagagtaatggtaacaccatgactggagcaagcggaaggagactattgtccactgatgctatccgttgagcacaatgtggggttactccttaagccagagtcaccatgggctttttggctcctgaaccaatagatttcatttgtattcaagccactttgtactaggttttccatcatttgcaatcaaaaccagtatacaaatactggttatttaatttttcatttttactaatctcatggaaaactggcttctagttgttttaacttgcctgtatttgtgattcttcccattttcgtgtacttactaatcacttctatttcttttgtaaattatcttttcatatttgtccactaattctttaaaattagagtacttttcttctccttattgtttatgtaattgttaaacaagactgaataacctgcccaaaatccgtggacatgggagcccatgtgaaagctttgaaagccaccatcattatgagataaactatataacagtactttacatatgctccaaaatacagtacagacacggctatcattgtcatgatcatgatcatcattatcagcatgatcaccaacttaggaggataagcaagaacacctactagaagtttctttccattcagcaacaaagttggcgtttttctagtcactcccttccctgactgagtcacatggcaggtcacagaggctcaatggcagaatgggaagctctgggccagcaccagccattgtgtgcatccttgcgtgtgaacctaggtgctggaagaggagtgactgcttgataattatgagtcagtcaaaaccaccaactgtctgacaaaacagacctctttgtaacctgtattgtcactaaaccaatgcctccatgctttgtgcatacatgaaatctaggcaatacacttgtattccccaaagcttccatttgaagagatctgtgctcttcccaaatgtaaaccttacccgagaggtggtcatctggccgcacctctgagagggatagaagtcttgctgtgttgggtggtcagactggggctcagggccagaattcccagggggtaggattgtgcagagaagatggcactctccagtgcttaataaaatgcacgtggtctaagttgcccattccctcaaaggcaataaaaaaataggtactatttaaattgaagagtaactactgccccagcgaatggacaggttgtcatcggaatagccatggttaatgccccagcgaatggacaggttgtcatcggaatagccatggttaatgccccagcgaatggacaggttatcatcggagtagccatggttaatggtcagttgactgactgaaatgaatatgctggctgaccaggaaagctcattaagcagacttggaagagagtctttccaggtaaatccacatttacaaattaaagcagtaatgacacctaattctctaataataggtggggtgcagtgtattttagagctgggaataattccaaacagcaaatagttcaaaatttattttccatttagcatatgcatgcatttgcttaaactatcttaaaaatgagtaaaaaatattgtcagtttgcttgaatcatactgagatgcggaacaatatttagcactgcatgctagaaaaggacacaggattgggagtcagggctgggtgactgtcgcaggattttcattaagtgtgtggatcttgggcaagtctgtatgccctgagattcagttatttaactttctttcaaaaaacctaatccagatgcagataacaaaacctgcttctaacttcccttacagaattgtgagaagctggtggagatgtttgtaaccaaagtgttttgaaaatagagcaaatattattctttttaaggcatgatattttcatagcatgtcaggcaacagggaaaaactaagttaggattttattttattgtgggtaatttatgtgcaaattttggtgcaatttaatgaaaataagccaaagttttaatgcagaagtgcccagaaaattaaataacaatctacattgttcaaatggttgccttaatatattttattttctcagcataattagaattatattatacaggtcttggagtagtcagtcagtgggagaagttaagacaacagatatctttttgttaaaattattatttgaattatctcaaattaacttttatggttctatcacaggatgtctgactcaactatatgaaaacgccttcttcagaggtggggatgtagcttccatgtacaccccgaacgcccagcactgccagatgatgtgcacattccacccaaggtgtttgctattcagttttcttccagcaagttccatcaatgacatggagaaaaggtaaaagttgatatttcattattggagaagccatttttctaaactgaatcggttttgtgcaaagaggtgtagtataactgagagttctgtctcagacggggctcaaggaccagcttcagcaaaatcccttcaagtggttcttaccaatgcagattcctcggcaacaacccagatttgctgaaccaaagtttcttgggactagaaattgcattttaaacaatcactgtgtttatttaaagtagtagaagttagtcattttctattcaaagcctcaaaatgcttgaacatcgttgggctaagagattgtctccagaaagcatctaacaggcgaacatttcatctgaataaagaaacagacttaactgtgtgacccgtgatcacattagtggctagcacagtccgaaggaaataacgtaagacaagcattttgcggagaatataattgagaaacatctagaacttgtgattttgggacagggcagatctgaatgacgcctaaagtgagccagtttgggcacctatggcatgatgctatgtatggtatgtgtgtgttcatgtgtgcttgtgcttgtgtgaatatgtattattaactggagatttgtaaaagtattggaaaaatactacttatgattttttttttttttgagatggagtcttgctttgtaacccaggctggagtgcagtggcacgatcttggctcactgcaacttccgcctcccaggttcaagcgattctcctgccttagcctcccaagtagctgggattacaggcacgcaccactacatctggctaatttttgtatttttagtagagacggggtttcaccatattggccaggctggccttgaactcctgaccttgtgatccacctgcctctgcctcctaaagtgctgggattacaggcgtgagccaccgcacccggctgtaattacaatttttattacatcagagagatgcttattaatcacaagctacagtttcatcttaatgattttcattttgaataagaataagcttttctttgttcttcccatttccatattcataactcttttctcatcttctccacgtgagtttgtgaactagaaattggatagtcattctctgatcctacatgttaaacttgtagagaaaacccagattgtatgtgaggatcatcatcttaaaagtggaggtaggttctagaattcttataaataatgaaattaacatggaggctgacatttgagacagagggaagtctttcattaagtgcagactacaaggagttaataagcaagatgaacacacaatatacagatccagctcttatcactaagttaattttttaagtaaatgaaagtatttgcaaaaataattaccaattaaggacatagttgcctgaaggtttaagaatacaggaaaagtcattaactcttcaatgtggttgacttcctgtacttaaaaaatgtgagtgtaaagaaaacgcaatgctgaagttaaatattatggggatgttataaaattacctctaagagtgttctttccagcaagttttggggaagctatattatttcccttattcctggttttatgttagtgtatagaaaatgctagacatttcctcaatgtatgtttgttgttctacttcctaaataaagctacttttaaaacaggtttggctgcttcttgaaagatagtgttacaggaaccttgccaaaagtacgtcgagcaggtgcaatttctggacattccttaaagcagtgtggtcatcaaataagtggtaagctgcgaatttcttagctacatttgagttaatattgaatctaccttagaacagcttttgctaaaagtctgtactgctacagcctttgggaaggaatcactcataaagatagaagatggggcagtattctggacacaaaagagggacccatattcatctggacacttctgttgtctttatcaatcgacacgtatttaatgagcctctattatttatgaggttagcactcaagtgtaagatttgcagaaaatgaatccaaataatcgtgtctccttgtttccagataagaatttttaagaaaacacgagggaacatctctctcaggttcacgtgagggtaatttttatatcagtgattctcaactggcagtgatttttgtctcttccattaggggacatttgacaatgtctggagacacttttggttgctatgactagggagggcgttattagcatttactaagtagaggccagaatgcctctctcatttactaagaagaggccagaacgttcgaatgctgctgcccaaccttctacaaggcacagagcagtcctccacagcaaataatcttctggcccaaaatgtcaacagtgctgacatcaagaaactctgatataccattaggcccaaactgaagaactgggttctgcaaatcttgctaagaataatacttcttaaaggaaacttgaggactaggatgctagagaactttgattttacatctgaagctactgatgtcttgggaaataatttccaacactatcctaataaatttaagacaaatgaactatttctcaaacatgactgggactgatcagaaagtgagaagtgctgaaaagattcaactgatgggttgtcggaatcttaaaatagctgtgctgtgattctatgtgtgactatacatcataactattttatttgtattatgcacaattaattttgtaggttcaaatttcagatgtttttaaatttgtcatcctttcctccctcattgatatcaccccttcgatacatacacactttgagcctgctgtttgcatgttaaccagttatcaaaggatggcaaagcgttcgttatgaatatgggcctgacttagccagtgtaataagtgtagtctacctgaggtggggtacatttcctgttttataagaccaatgtgtatgttcatctaatttggtataaagtattcaaggaagtgctgtttccaattgttgtatcttatagcaaaatttaaagaaaaagtaacattgtgccttccccaatattcctgttattgttaatgtattctaaaactcagtgttactcacttagcttgcttttaatgtttttttctaacttcatcatcttaaagtgaaaaattgttcccaagtacataaaatctctactttcaggaacaattctagtcgaaagcatttagagctttcacatgaacacttacaaagttgttatttgtgagagtcccatcccaactcttagcctactcttttctcacacgcagaaaaattggaaagagatttcatttcgaccgtctgcaaattcctgtgtttaagaaccactgtgaataatccacctccctacccaattcccaattcgacatgcagttttcctgacagtttgtatgttttctgtctttcccacccttaaatttagttttatgacttcaaccacacttcttaggagtggaaagttacctgtaatagattatggtttattccacataatcttggggaataaaactttaaaaaagtttatggtttagacttctggtttacattacttccttaaccaaaagtctaactaagaaatttgaatatttaaaaaaaaaaagagcctaattttgcttccttgtctgtgaaaagaattatctatatcttttgcatgtaagacaaatctcagtgaaaagggtgcttaaatagaagttaacactattttaaagcaagaatggaagtggcttcatcatgcataaacaacaactctccacattttgtaacgattgatccagatgcaatttgtagtcagacaggagaagttgaaagcagagaaagaacactgggagatagagaagctccttcattcaatgcaaaaggtcaaaggcacatcagtttctttaataatgcaaacctcagcacacatgatcagtgtcctcattattattgccttgtttatttcccactgctcactgttaatttcaacgtgaaatttacctgtattgctgcatgcatcttgcagtttaagaagcgaagtaacccaatttccaagctagtgctttcaggaaaatactggattgtatttacttcgagcagagtttgataatttatggacatcataaaaattttaaatcccttaattaatatagcaattgccaaaactgggctgttatccttctaaactaccggcccaaatggtagtgggatccttctaaactaccagcccaaatggtagtgggtatctaatctacctctagaaagaaaatggactgtgtttgctctatttcctttttcttgtacagcttgccaccgagacatttataaaggaattgatatgagaggagtcaattttaatgtatctaaggttagcagtgttgaagaatgccaaaaaaggtgcaccaataacattcgctgccaatttttttcatatgccacacaaacatttcacaatgcagagtaccggtgagtacaattcatggtgtttgttctttatattagtgcccccaggatttcactgtattcttcacaacctcttttgttcccaaactaaaaaccaaacagggcttttactcctaaccactttccttatttacttactctattttatatttttatcttctttttttttttttttttgagatggagtctcgcgtgttgcccaggctggagtgcagtggctcaatctcggctcactgcaacctgtgcttcctggcttcaagcaatcctccttcctcagcctcccatgtagctaggactacaggcgcccaccaccacacctagctaatttttatgtttttactagagacggggttttaccatgttgctcaggctggtctggaactcctgatctcgtgatccacccacctgggcctcccaaagcgctgggattacaggcatgagccactgctcccggcccttcattttaaagttaaataattcatttaatttcatttgtttctctactcttttcctctggcaggtaattgtaccccatcttcaaagcctggcatcctcttccaccacttctccaaaggctgattctttcaggtctttcctcagataccgtcccctccaaagggccatttctgagcattctcttttaagccacattcagctctgtttatttcattcgtagagctaatcacaatttgattttaacttgtgaatttctttccttatttttaaatctcgtttttgtttgcatagatgtatggggtacaagtgtaattttgttaccttggtgtattgtacagtggtaaagtctgggcttttggtatatccatcactggagtcacgtacattgtacccactaagcaatttgtcatcacctgcccctttcccacctctctatcgccttcccagtctctactgtcgatcactccatgctcttctcaattgtggtgtcatttttcctgaagcgaaatttcggtgtcattgtttctgaagtcattttctgacgtctgtgtcattttttgctttcctgaagtgaattttggtgtcatttttcctgaagttccatttgccccacgcataggccttacttgtagaatgagggtttagtgtcatggtgtctcctgcctcattctcaccccaactttcccttgacccctttgcgaggagaaggatgtccatttgattaataatgcaaacccctaacccactcattatcagcatcattgttttttccactgtccgtttgaatactaaatgttacctggactgctacctccgcctcaaagtgcaggaagcaaagtcacctcttttcttcccattcaggaacacttgcctcttaaagcacagtcccggaggaacgcctaccactataaaggtgctgaataacgtggaatctggattctcactgaagccctgtgccctttcagaaattggtaattgtaggaccacttcaccttgtgattgtagtaggcggaataggaccccccagagatgtccctgtgcggagccccggtacctgtgcgtgtgttcccatagctggcaaaagcgtttctatcaatgggattcagttaaggactttgagatggggagtttactctggatttcctcgatgggcccaatgtactcacaggattgggtgctcacaaggctaataagaaaaagggagaggcagaagggtcagaggcagagagaggtttgaaggtgttacactgctggctttgaagatgaaggtccatgagccaaggaatgcaagtggcctctagaagttgaaaagggcgaggaaacagtttccctgtggagcatcctggaggaacaagccctgctgatgtcttgattttagcccagtaagacccaatctctagaatggtaagataataaatttttgttgtttttaaccactgagtttgtggttatgcccctatagcagcagttataggaaactagtacagtgatattgttataggtacaatgatattgtagcaaaactgtaaggaccttccttggttgtgtccctatctagggaaatgactctaccggggggagggaaataacattctgtcgtgtcacacataaaggtaatttcaatggaattgtccagaaaattgccatgacattccacctcatttagcgtatcaggatgttaacgacaagatgttactgaaaccaaatcccttactgccagttctccgcagtagtgggtgctggctctgtgcctggccctgtattgggtgctgggctaggatttccctgtggaagattgggaaggttggttacaaggtgtctattttcctgtctcctctttgtgacagcacaccttctccacggtgcgtgccaggttcacgtgtactgatgatgtgattttaacgttcatattatttttttccgggagagtttttgaaggctgccaggaggcaggactcgatgcaagcatgctccattctgtacccagcactgttgctggaaggatttgctgcacttacccagggaacaggcaagctcatgccgtggttctgggctgtcacagctgctgtccacacctgggagagcaccctggatggctcatctctgtacttgctttcttgttaaattgcagtgagttcacatgtgatttaatctgatcaaatggcctttacagactggtaaaaatctggctgtttcaggcagtgttttgagctgctaaaggcatggcttttcactgagtacgtgttccccgttcctcagggaacacccagtagctacgtgcctcctcaacctggagtagggctgtctcctggcctcactgcccagatgagattcataagttagggatcatctgtagtcatcactacaggtttgtccttagtttcaccatggatttttctaattttacaaacaaaacccctaaggctcctagaaggagggcagaagtgaaggtgcttgggggtcatatagctgatgagctgaacgagaacttgacccttgggtcacacagatttcacattgctcactccccattttgattttttaatggatttaatggtgttttaaagtctcctgcctctcaactcatataaattcatcatatttacagatttccttctcttgcggtccatcttcctgcatagatcttgacagatgtcagggtaatcacatcttcccagttaatttaacaaaaccgtttgcaattctgatatgggaaatctaccatatgacttattaatttatcaattgaggtgataaacatatttttcaagccaaaagtaggagaacataaactggaaaaaaaagtttttttattttttatttttttatttttatcacctctggggaagaaaatctgataaatgaacctggttgatgaaattgcaattagtgggagcaacatcatggtttctgttctgagaataaccagatggtatacttgaaatagagaatgtcctagaaatcaactggttgcttggccaaaatatctataaatagtgcccgacatattagataggaaaagcaaagtaaaagcaattttaataggttaggacattgggctgaagtattgcatatatttaatgtcacgtgcatctgtgtgaagagaccaccaaacaggctttgtgtgagcaataaagctttttaatcacctgggtgcaggaaggctgagtccaaaaagagagtcagggaagcgagataggggtggggccattttacaggatttgggtaggtaacggaaaattacagtcaaaggggttgttctctggtgggcaggggtgggggtcacaaggtgctcagtgggagagcttctgagccaggagaaggaatttcacaaggtaatgtcatcagttaaggcaggaaccgactattttcacttcttttgtcattcttcagttacttcaggccatctggatgtatgtgttcaggcttaggcccagaggcctgacattcctgtcttctcatattaataagaaaaataaaatgaaataggagtaaagtgttggggtggcaaaaattttggaggtggtatggagagataacgggcaatgtttctcagggctgcttcgagcaggattaggggtggcgtgggaacctagagtgggagagattaagctgaagaaagattttgtggtaaaggttgatattgtggggttgttagtgggagcatttgtcgtatagaatgattggtgatagcctggatatggttttgtatgaattgagaaactaaacagaagacataaggtctgaataagagaaggagaaaaacaggtattaaaggactaagaattgggaggacccaggacatctaattagagagtgcctgagggggttcaacataattagttgcttggttgctgagtttttgggctctatccttgacagagtcctccttcttaagttggaggctgagcttggtgaggtgtgtttttaaaagaccattagtcctttctacctttcctgaagattgaggagagtaaggagtatgaaggttttactgactactaagagcctgagaaactgcttgggtgatttgactaataaaggccagtccattatcagattgtatagaggtgggaagtccaaaccaaggaattatgtcttacagaagggaagaaatgaccacggtggccttctcagaccctgtgggaaaggcctctacccatccagtgaaagtgtctgcccagaccaagaggtattttagtttcctgactcggggcatgtgagtaaagtcaatttaccagtcctctgcagggacaaatccccaagcttgatgtgtagggaagggagggggcctgaacaatccttgaggagtagtagaatagcagatggaatactgagaagtgatttccttggggatagatttccacaatggaaaggaaaagaggggttttaagaggcaggctagtggcttgtaacttacatggaagaggttacgaaatgatgacagaatagaatgggcctgtgaggctggaaggagatattttccttggtccaagaactatttgccttgtgtgggaagagattgataggtggaagtttcaatgtgggagtagatgggagtgaccgattagagggaggaaaaactggccgtgagggacagaagttggaatgctagctgcttttataactaccttatcagcatgggtgttgccttgagcaatgggatctgatgccttttgatggcccttgcagtgaatgactccagcttcctttggacgtaaagtggccttgagaagagtttttattaaagaggcattaatgatggaggacccttgcagagtgaggaaacctctttcagcccatataacagcatagtggtgcaggatatggaaggcatatttagagtcagtgtaaatattgatgcatagtacctttgcaagagtgaggacctgagttaaggcaatgagtttggcttgctgagaggtaagttaaggcaatgagtttggcttgctgagaggtagtggaggggtgcagagtggtagcctcaatgatagatgtagaagatattatagcataccctgcctttgctggtgggtggagattaggcctggtggaactgccatcaataaaccaagtgtgattagggtaaggaataggaaagacagaagtatggggaaatggagtggatgtcaggtggatcagagagatacagtcatggggatgggggccagcctaaaacagtaaggtcaagttgtttctacagaaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggcgaggagcagcctggggaggaggggagaggtcagatgggtccatagaaaaggaagattggaaagactcagcaacgcttggggttgggattgaggggacaggcgggagggaaagaaggaagatttgggatgagttgcattgggaacaaagactagggagggactgatgtgtaaaagactgcctggacatcaggcagctcagaccatttgcccattttacaacaagaattatctagatcttgtaggatggaaaaatcaaaagtgccgttttctggctatttggaaccattgtcaagtttgtattggggttaagcggcattgcagaagaaaataaggcgttttggttttaggtcaggtgtgagttgaagaggttttaagttcttgagaacataggctgagggagaagaaggaggagtggagggtggaaagttgcctatagtgaatgaggcaagcccagagaaaagagagggtagagacacggagagaaggggtcagggtgcttgccccccaggaaagtggtgcttgccactaagggtgaaggatcaaggcaggcatccctaaggtgatcagacacctctgaaacatgggcgcataatcaagcaggtgtccctgtagtgattaaatgccaagggaagactgtcttcccgagtccatgactggtgccagagttttgggttcacagataaaacgcgtctcctctgtctctaccagaaaatgaaatgaattgaaattaagagaagggagagattgaaggatggcgccaagattaaaaggagaaagaggttgagggatagtgagagagattggataagagagtaaaaagaggccgtttacccaatttaaaattggtgagatgttccttgggctggttggtctgaggaccagaggtcataggtggatctttctcacagagcaaagagcaggaggacaggggattgatctcccaagggaggtcccccaatccgtgtcacggcaccaaatgtcatgtgcacccgtgtgaagagaccactaaacaggctttgtgtgagcaataaagctttttaatcacctgggtgcaggtgggctgagtcagaaaagagagtcagtgaagggagataggggtgggccgttttataggatttgggtgggtaatagaaaattatagtcaaaggggttgttctctgatgggcagggttggagctcacaaggtgctcagtgggtgagcttctgagccaggagaaggaatttcataaggtgatgtcatcagttaaggcaggaaccggccattttcacttcttttgtcattcttcacttacttcaggccatctggatgtatgcgtgcaggcttgggcccagagacctgacatttaacatgaataaatgtgaagttcttagaatcatacatacacattggaaaagatggggtttaatagcactttataaggagacttgaagaatgtttgagaatccaccatgaagctgctgaaaatatcaagaaaatttaattcttatgtatataaataatgtgtctgttttacatgaattccctctatcaagtttggtattttaatatagcatatattattttttcatagtagatttaaaatttttgatgtataatttagataacataaaattaaccctttgaaagtgtacaactcagtggtttttagtatatccacctgatttcacaagaatcaccactatctagttccagaacatttttattaccactgaagaaagactgtatccattggcagtctttctccattgcctactcctccaatcccctgacaaccactaatctactttctatgtctgtggacttgactcttcgggacattttacataaatgcaatcatgcaatgcagcacattttgcatctagcttttttcatctggagtgttttcaaggctcattcatattctagcatatatcggtactttgttcctatttaggactaaatagtattctattatatgaataaaccatattttgtttatatacttagtttgatgaacatttgagttgtttctggattttttttttttttttttttttgcctcttatgaataatgctgcaatggacagcagtttttgtgtaggcatacattttaaattatcttatgtatatacttaggattaaaattgttggatcatacagtaactccatgtttaactttttgaggaagtgtcaaactgtttttgagagcagctacacaattttacattcttaccagcaacaactgagtgcttcaatctctctacaaccttaacaacacttgttattgtcttttttattattgcctttctaggcagtgtgaagtggtgtctcactgtggttttgatatgtatttccctaatgactaataatgttgtgtatcttttcatatgcttattatcaatttgaataaattctttggggaaatctctgtttaaatcctttagccattaaaaataattgggttattttgttttcattgttgagttgtatgaactctttatatactctggatactacactcttgtaacatatattattggcaaattttctgtgcatctgcaggtcatcttttcactttagtgatggtgttctctgaagcgcaaaagtttttaaacttgatgaaatacagtctggctttattcttgcatgtgctttacctaaaatgccaaaacctaattcatggttatgaagatttttgtgtatgatttgttcttagaggtttatagttttagctcttacatttaggcatttgatgcattttaaattaaattttgtatatggtgtaaagtaggaatccaacttaattcttgtatgtggatattcagttattccattgtcttgaaactcttttcaaaatcaattttctataaatgtaagagtttatttttagaccatcagttctatcccattgacctgtatgtctgtcctaatgccagttacacacagtcttgattaccataacttcgtagtaagttttgaactcagacagtctgagtgcttttattttgttctttttcaagattaatttggttattccggatcttttgcatttccatatgaattgtaggttggttgtcaatttctgcaaccagaaggcagcaggattttgacagagagggcattgaatctgtagaccaatgagtatcaatagaattatgtgttatcaaatttagtaaactacgtaaacgataggaacacagctaaaataaaactaagatataagatcgtattaatgtaatgttaataaaagtagattgtctcccattctaattttaatgggcacaaggcatttttgttaatcacttcttattaaataattttttataatattcaggaaaatacaacaacaaaaaacccttacattccaaaggcctcagagtcagagtaatagaaggaaaacgtaaacacatgctgagtaatgcaaacatttggcaacggtggtgactggagctgggagcacagcttttatttctctgacataggagtttgccccttagagttggaccagttttgccttcctctaaatgacaaacagtttggaggtattttaaaggacgttttgtcacttaggatgtttagtaccatgaataatataaatagtcataattccttaattacgatgacaaaatacaagcgaatttagcatcgtgtggtttcctaaggaacatctctctctgagttcacaggttgtcacatgaacatcttccagcatcttgccttctcggatgtggatgttgccagagttctcgccccagatgcttttgtgtgtcgaaccatctgcacctatcatcccagctgcctcttctttacgttctatacgaatgcatggaagatcgagtcacaaaggcgagtatgcatggctagcacttgctgctgtactttcatcaattttattttagagtctgagtttttaaaagtttccttcatttccctcaaaacacttggacctgcagtttaagtaggtacttttctgccaggtgcagattagttaagagattagcagacttctctgcctgtcttctcttactttaaaacacatgttaccagctgggtgcggtggctcccacctgtaatcccagcacattgggaggccgaggcgggtggatcacgaggtcaggagatggagaccatcctggctaacacggtgaaaccccgtctctactaaaaatacacaaaattagccgggcgaggtggcggcgcctgtagtcccagctcctcgggaggctgaggcaggagaatggcgggaacccggggggcggagcttgcagggagccaagatggcgccgctcactccagcctgggtgactgagcgagactccgtctcaaacaaaaaaacaaaaacaaacaaacaaaaaaaaacacgttaccattgaatccaggaagcaatagccatgagaacaaagaaggatctgacgcctttgaatgaagattcaaaacacgatcttcacgttttgtattagcttggagtaaaagccactccctggcagaatatcccttaagcttgttgcctcttccctttgtttcagaaactagagctctgtttattctgatcaaggctctgtcccactctctttatctcagataacccaccctcttctacacacagcatggagctaagagaagggtgcctagttatggaatatcatcagcagcataaactcccagaatttcttctttgatttttttgtttgtttgtttttccagttagaaggtggaacttcgtcactgtcctctcttcaggttgtctgtgcctattagttttctccagagggagatgtggtttgatttacatttaatctctgcaatttattagagtcctgtagtcggatttacttggaagagagtttcccaaaagaataaaatttgccaacttcctttttgggtgtgagctgcttttgtatttgcctaatgcctttaatgcaaacttcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaactttacctggtaatgtgattcaataataatattacataaaacgtaacatatttcatgacttaacagcaacagtgttgaaacaatccacaaggtaacagaaacttttgtaaatgtcgttcattgcttttctcatttggtatcttttcatgtttataattgacacagaaccctgccattctaaaatttacccgggagttgactttggaggagaagaattgaatgtgactttcgttaaaggagtgaatgtttgccaagagacttgtacaaagatgattcgctgtcagtttttcacttactctttactcccagaagactgtaaggaggagaagtaagggacattttatttttcatgatcatttcatatcctttttcccctagtgaaggcttactctttctactgttcatttcatctaggtgtaagtgtttcttaagattatcttcggatggttctccaactaggattacatatgggacacaagggagctctggttactctttgagattgtgtaacactggggacagctctggtgagtaacctcactttttcatggaactgtaagggatgtctgtcatgttgatagtgtgcttagtcttaaggaattatatgtcttgttctccttggttagaagggactttgattcacttctaatttcaaccattagcatcaacactcttgtttcagtctgcacaacaaaaacaagctcacgcattgttggaggaacaaactcttcttggggagagtggccctggcaagtgagcctgcaggtgaagctgatggctcagaggcacctgtgtggagggtcactcataggacaccagtgggtcctcactgctgcccactgctttgatgggtaagtgttggatgcatctcatccagagtcttaccttgacttttcattttgaagggtctgtgatcagctgcttcaccgtcatgtgactttatgaatagagacgtgttaaagcagggatggtattcacaacatttaactagcagagtccaagcactgaccagtctgaccatcataacagagtgtggtctctgtacaggactgatggccctgggtgggtattctcccacagaaagagaaacaaacacaatacaccactcctccaacccaccacccgccaccaatcccaccacccatcccaccacacaacccaccacccatcctgacaccaatcccaacaccaattccaccaccaatcccaccaccacccaccaccaatccctccaccaatcccaccaccacccaccaccaatcccatcaccaatcccaccaccaatcccaccaccacccaccaccaatcccaccaccaatcccagcacccgtcccaccaccaatccctccaccaatcccaccaccaatcccaccaccacccaccaccacccaccaccaagcccgccaccaatcccagcacccatcccaccaccaatcccaccatcacccaccaccacccatcaccaatcccaccaccaataacaccaccagtcccaacgctacccaccaccaatcccaccaccaatcccagcacccatcccaccaccaatcccaccaccaatcccaccacccatcccaccaccaatcccaccaccaatcccaccaccaccaatcctaccaccacccaccaccaatcccaccaccaatcccaccaccaatcccaccaccacccaccaccaatcccaccaccagtcccaccaccacccaccaccaatcccaccaccaatcccaccaccacccactaccaatcccaccagcagtcctaccaccaatccctccaccaatcccaccaccacccaccaccaatcccaccaccacccaccactaatcccaccaccaatcccaccagcaatcccaccagcaataaatcaaagacttatttctcaggcccatagaaatgttacttcttgctttttgattaataaatatactaataataatttttaaaagtgagagttttgtactccgtatatttcaacatatgtaatttgatctatttcagttttattggtcaaatagtagacatgttaggtaagtcttaaaacactgaggttttggagttagacaaaacatggcttgagtgataactttgctgcttattagaggtgtggccctaggagatttgtaaatctctctgagctttattttatctaaaagataaataataatagtacctaatttgtaaggttattgggaggattaagtgacacatttaaaatgcttagtactatatgtcgaacatgaacactgctcaacaaatgtaaactatgatttctatattcaataagaagtgtagaaatggacaaagcatatgaaaaagcaaaagaaatactagaagacacttgatttttctaaaaaataaacacaaagtatttttgttttagtgaaattcatgcttagatgctgtgtactaggattgaacatacagccgccaaaatatagcagttggtggtacatgtgggtggagcaagacccctccaccttgtcaccgtgaaggggctccgccatacatgcccttgcatgtggtttaaaggtggttggcctggaagaaaaggcccaagatgggaaacagtaggtgtcttttttactaaatgtactccaatttgagaccaggaattttcattcttgaaggctcagtattgtaagtttataagagataatagacataaaagtacgatgatttcattaaaaaaaggctcctttgcacgtgatatctccgttattttttctagaatattgtgcacacatgccttgcaccacttggtgatgataaagatttctagatctttgcacagaataaggctttgctttagatcataattttggatgtacttagtatgtattcatcttttaaagaatcaatttaaattttcatactttcatatatatatacacacacacatacacaaacacacgcacacactttattttaatattttatttatttatttattgagatggaatctcactctgtcacccaggctggagtgcagtggcaggatctcggctcactgcagcctccgcctcccaggttcaagcgagtctcctgcctcatcctcccaaatttttgtattttcagtagagacggggtttcaccatgttggtcaggctggccttaaactcctggcctcaagtgatccacccgcctcggcctcccgaagtgctgggattacaggtgtgagccactgtgcccggccgtatagagatattttaaacaacactgaagtcctcctactctgcctaattagaagagcattgaaagatcagtctgacttcttgatagttctgaatttaatggagcaatgaggtgcagctttggtgaatgagcttaatttttccatgataaattgctagtctcttcccactacagtgtctctcaaaaatgggacagcaacattctttgtgttttcacttgcagtaagtaagcatgatacaattacataaatgtacacttctcagtttgttaaatagaatcttcagagattcacgtctgccgctattggtgatgaaaaatgacccgtaggaggaattaggtaggagaaaatatgtcctatgtagtatttccttcccagttctctttgaaagagagtgataggaaaaaggaacaatattgaaggaaggccttcccagtttcaaataggttttatttttctctcctaggcttcccttaccggatgtttggcgcatttatagtggcattttaaatctgtcagacattacaaaagaaacacctttctcacaaataaaagagatcattattcaccaaaactatagaatctcagaagggaatcatgatatcgccttaataaaactccaggctcctttgaattacactggtatgtagcgtatgtaagaaggcggatagcagaattgtgctggatgatattttcatatcagtttggacaagagggcagatctagagagactgttgttattttctgaccggtggagttgagggaaaggtgagggttgcatgggaagtgaagatcccacgacttgccatgaaatctcttctacgtaaagagcaagaaacgtgaattagttctttcagggaggagcacagccgcgcgcaggtgatggaaataatggacggaggagatgtctgtgccgtctgagaggcaccgggcttcttttgacaagagtagcagaactgtcattgctttgggcttagggatattagaatgtgtgaggaccagtgggactagatacatatttccaggtataatttgggtaggaaagagactgatgccgaaagaagccctggaaaggccagaacatcgtgatcagaggtgttgcctttggaggttcattgctgccaggagctgaatacccactgtatccaataacattaatggccaggcatggtggctcacccctgtaatccccacactttgggatgcccaggtgggaggattgcttgaggtcaggagtttgagatcagcctgggcaacacagtgagaccctgtctctacataaaattacaaaaaaaacaattaactgggtgtggtggtgtgcacctgtagtccaagctagtcaggaggctgagacaagaggatcatgtcagcccaggaggtcaaggctgtagtgagccaagatagtgccactgcacacaattatgtgaccttgggcaagttgctttacctctttgcacctcttaatttcctcatctgtaaaatgaggatgataatttcttcctgggtttgttgtaataatcaatacattaaagcacttcatgtctggaacagtgaagacacctgctatgactattaaggatagcatacacggaataagacgcaggaacttctaaatgcttttgaccgtagatttaggttctgagttttaagaatgtaactcaggaaattgtaacaccaaaaaggtcatgtgaaaaatggtggtgacaaattttcttgaatcaatagccttagaagttgggcagaaagcaaaaaagttattcttggtgctactctatagaaagagaagacagaaaaagaaaaagatgtatttttaaagtctatatccataactttatttgaccaaactctaatttaaaaattatgtttcagaattccaaaaaccaatatgcctaccttccaaaggtgacacaaacacaatttataccaactgttgggtaactggatggggcttctcgaaggaaaaaggtacagcatgatgctttaaatattgcttctagagtaagtcttacatgttgagatgcatggagtgggtcgttttaatcggcttctctctgaaattatatcgaacccctttatctttcctacctatttattccccaatatttattcagttattcttaaaaaacgtatttttgctttggcttgaaaaaaaaattttagggagaattttaagcatcttacttcattctaaagatcgtttgcttgacttcgcatgaaagattgtccccatctaaggctgacgagcccgtgcaagaccatctggtcctcagtgttagcagcattcccatctcccaataccatgttctcccttgatgctaatggccgggagcacaggcaggcgtgtcgcctctctctgtggccagttcttcatcttcttcttccaggcacccttcctgcaatctgaggaagcctaggaaccacttctctaacaatgcttttaaatgcttaaataaaatacacaggattacaaaagaaaccaagtgaagtgcaagacagttctcaaaatactttcaaaaagtactacaataatatatatgcctctttattaatcctctacatagcgagttattctaataccaaacctacttttgaaatagtggtgagcataaatggcattttcacttatctgccacaacagaaaagggatatgaaaatatctgtaatctctgttgatggcaaagtcataggtgccactgatactgctgtgtttgttgtctgcattcgtaatcgaagggagtggtaggcttcatctggaggtttgtgaaaacaaagactttttttctacacaaatttataagccatgtgaattctttctgaggaccttaggtttgcaattcctacttgtgggtatctggagtgttccaatcgtccttgaactttttaaaaaacagaccagtctccctttccaaaattatgttcctgatagacactatggagaataatatctgtgtcattctttacagaagaaggtagcttgccaaactctctccatctttcccgattcagtccttagttcaagtgattcacatttttagattttttactggtaatctgagacaagaagaaattaaaagtaatcttcactaagcaacgaaagctcccaacactgtcctccccatgagagatgctcgcttgcatttactcagaaacaaaagaccccaagacccctctgtcgcgaaagctcggagggcttttcagaaacgatagggctttcaattataatttggaatatatgaaacaaaaaaatgaaaagtgagaacttccaggctttggatttttgtagatgataaatataaaatgggatttctgggggactgttaccgagatgaggggatggaagaagacacggaagcaaggtctctggtcagcccagggtgctgggcttgtcccaacaccacacaggtaataagaggacagtgcagggctccgtgtctctctctctctctctctctctgtgtgtgtgtgtgtgtgtaacactaccttcctaatttttactatttgtattcaaagatacggcccttataaaaaagtacactgctctgattcacttgaaaacttatttccatatttactatttattgtgtttcctccctctgaagttatatattggttacttcacaggtgaaatccaagatattctacaaaaggtaaatattcctttggtaacaaatgaagaatgccagaaaagatatcaagattataaaataacccaacggatggtctgtgctggctataaagaagggggaaaagatgcttgtaaggtaatgcatgagattatgaaaaacacaataggctgcttgagaaaattcacttcaaaatatattttccaatagcataatttattatagtttttaaaaaaaattcagagacaaatgatctgataaatttataagcaacttttaacaaattgaatatatacaatacatatttatattattcatgatgtatgtcacaatctatgcatgtgctaatttaagagggacaaaaatacatacaataattgcactaaaatataaaaacattagatttctttgtcattgggatgatgatatcaagatttctttgttagatttatttaagaattgaagaggggatacaaaaaatgcaggcacatgagatacttggagaactttaagaaagtttgtgtgtgtgtgtgtgtgtatgtgtatgtgtgtgttgctgtgtagtggactacagaattttagaggtggtcacttatttgagtcccattgtcataactttctaccattttatttttcccctgtgactcagggagattcagggggtcccttagcttgcaaacacaatggaatgtggcgtttggtgggcatcaccagctggggcgaaggctgtgcccgcagggagcaacctggtgtctacaccaaagtcgctgagtacatggactggattttagagaaaacacagagcagtgatggaaacgctcggatgcaggcgccagcatgaggagcagcccagagtcttggcgagttttacaacctgggttcaagtcaaattctgagcctgggggtcctcatctgcaaagcatggagagtggcatctactttgcatcctgtcataaggacaaaagacagtgcactcagagctgctgaggacaatgttttgctgaagccagctttcagcattcagtaactgggagctgataatgtgaagtcgcaaccgagatctccatgattgtgtgtcgtaaaataaaatggtaaaagatcacaattagcaagtgttttcttctggttgtgaaacagaactgaaagtaagtggttgaggttctagcacagtgcctggactccctctaattgcactacttcttctggaactcagtctatctcaaagatgtaatttcctctccttgctgcacctggttagccactgaaacccacgattgtctgcttcacttgtggcaaagagctagcaggcttgggttctgttctgccgagtggaagggagaacacctgcgtcacacccactcttataagaaagagatgggttacctgaacccatagggtatatttgcctcttggcctcctaactttgctactggggcatggataggagggtccaggctgcgtgtgtggaggaactcgaggggctgcagcattgcacagccttcatggtaggcaaggaatctgctttgcaaggggcattagccctggaggctcagtggatatgggctattgcaatactaattcaaggagcatttttaggatggcacattggctcatgcctgtaattccaacaatttgggagatcacggcaggtggatctcttgagcctaggagttcaagaccagcctgggcaatgtgacaaaaccccatctctacaaaaattagctgggcgtggtggtgcatacctgtaatcccagctcccccagaagctgaggcaggaggatcacttgagtgtggctgcagtgagcagagatcgcactactgcattccagcctggacgacagagtgagactctgtctcaaaaaaaaaaggaagcattgttaggtataaattactattatttatttatttatttttgaaaggagtctcgctctgtcacccaggctgcagtgcagtggcgccatctcggctcactgcaagctccgcctcccaggttcacagcattctcctgcctcagcctcccgagtagctgggattataggtgcccgccaccacgcctggctaattttttgtatttttagtagaaacggggtttcactgtgttggccaggatggtctcgatctcctgactttgtgatccacctgccttggcctcccaaagtgctgggattacagacttgaaccaccatgcccggccctgttaggtataaactatttcataaaattcagacttgtaaatttatcatagcctttagaatggatgatagaaatccttatgccacacaaattcctcatatgccagggctcaccataactgataccagctcacttgattcagctcagtttaacatttacacagaattggccatttacaaaatcttacataagttaagtagaaaaatagaaaagtgaggttttctgaaagagtttgggtttttccttcaatgctcaacaacagaggtccccaatctttctggcaccagagaccagttttgtgcaagacactttttccatgaaccagcgtggtgggggggggatgattctggaatgattcaagtgcatgacatttattgtg

SEQ ID NO: 19 - skipped

SEQ ID NO: 20 - DNA, 23 bp, Artificial sequence
  Primer
ccaaaaaaggtgcaccagtaaca

SEQ ID NO: 21 - DNA, 24 bp, Artificial sequence
  Primer
cctccgggactgtactttaatagg

SEQ ID NO: 22 - DNA, 29 bp, Artificial sequence
  Probe
cacgcaaacatttcacaaggcagagtacc

SEQ ID NO: 23 - DNA, 20 bp, Artificial sequence
  Primer
cctgtgtggagggtcactca

SEQ ID NO: 24 - DNA, 23 bp, Artificial sequence
  Primer
ccactatagatgcgccaaacatc

SEQ ID NO: 25 - DNA, 23 bp, Artificial sequence
  Probe
cccactgctttgatgggcttccc

SEQ ID NO: 26-29 - skipped (4 entries)

SEQ ID NO: 30 - DNA, 20 bp, Artificial sequence
  Synthetic oligonucleotide
aacggtcttcaagctgttct

SEQ ID NO: 31 - DNA, 20 bp, Artificial sequence
  Synthetic oligonucleotide
aaatgaacggtcttcaagct

SEQ ID NO: 32 - DNA, 20 bp, Artificial sequence
  Synthetic oligonucleotide
cttaaaaatgaacggtcttc

SEQ ID NO: 33 - DNA, 20 bp, Artificial sequence
  Synthetic oligonucleotide
tgtcacttaaaaatgaacgg

SEQ ID NO: 34 - DNA, 20 bp, Artificial sequence
  Synthetic oligonucleotide
tggaggtgagtctcttgtca

SEQ ID NO: 35 - DNA, 20 bp, Artificial sequence
  Synthetic oligonucleotide
cttcttggaggtgagtctct

SEQ ID NO: 36 - DNA, 20 bp, Artificial sequence
  Synthetic oligonucleotide
gcttgaataaaatcattctg

SEQ ID NO: 37 - DNA, 20 bp, Artificial sequence
  Synthetic oligonucleotide
tgcttgcttgaataaaatca

SEQ ID NO: 38 - DNA, 20 bp, Artificial sequence
  Synthetic oligonucleotide
taagttgcttgcttgaataa

SEQ ID NO: 39 - DNA, 20 bp, Artificial sequence
  Synthetic oligonucleotide
ggaaatgaaataagttgctt

SEQ ID NO: 40 - DNA, 20 bp, Artificial sequence
  Synthetic oligonucleotide
aacaaggaaatgaaataagt

SEQ ID NO: 41 - DNA, 20 bp, Artificial sequence
  Synthetic oligonucleotide
tagcaaacaaggaaatgaaa

SEQ ID NO: 42 - DNA, 20 bp, Artificial sequence
  Synthetic oligonucleotide
aactgtagcaaacaaggaaa

SEQ ID NO: 43 - DNA, 20 bp, Artificial sequence
  Synthetic oligonucleotide
caggaaactgtagcaaacaa

SEQ ID NO: 44 - DNA, 20 bp, Artificial sequence
  Synthetic oligonucleotide
atccacaggaaactgtagca

SEQ ID NO: 45 - DNA, 20 bp, Artificial sequence
  Synthetic oligonucleotide
cagacatccacaggaaactg

SEQ ID NO: 46 - DNA, 20 bp, Artificial sequence
  Synthetic oligonucleotide
atccccacctctgaagaagg

SEQ ID NO: 47 - DNA, 20 bp, Artificial sequence
  Synthetic oligonucleotide
tacatccccacctctgaaga

SEQ ID NO: 48 - DNA, 20 bp, Artificial sequence
  Synthetic oligonucleotide
gaagctacatccccacctct

SEQ ID NO: 49 - DNA, 20 bp, Artificial sequence
  Synthetic oligonucleotide
acatggaagctacatcccca

SEQ ID NO: 50 - DNA, 20 bp, Artificial sequence
  Synthetic oligonucleotide
ggtgtacatggaagctacat

SEQ ID NO: 51 - DNA, 20 bp, Artificial sequence
  Synthetic oligonucleotide
accttgggtggaatgtgcac

SEQ ID NO: 52 - DNA, 20 bp, Artificial sequence
  Synthetic oligonucleotide
caaacaccttgggtggaatg

SEQ ID NO: 53 - DNA, 20 bp, Artificial sequence
  Synthetic oligonucleotide
ctgaatagcaaacaccttgg

SEQ ID NO: 54 - DNA, 20 bp, Artificial sequence
  Synthetic oligonucleotide
gaaaactgaatagcaaacac

SEQ ID NO: 55 - DNA, 20 bp, Artificial sequence
  Synthetic oligonucleotide
tggaagaaaactgaatagca

SEQ ID NO: 56 - DNA, 20 bp, Artificial sequence
  Synthetic oligonucleotide
caaaccttttctccatgtca

SEQ ID NO: 57 - DNA, 20 bp, Artificial sequence
  Synthetic oligonucleotide
acactatctttcaagaagca

SEQ ID NO: 58 - DNA, 20 bp, Artificial sequence
  Synthetic oligonucleotide
ggcaagcacttatttgatga

SEQ ID NO: 59 - DNA, 20 bp, Artificial sequence
  Synthetic oligonucleotide
ttaaaattgactcctctcat

SEQ ID NO: 60 - DNA, 20 bp, Artificial sequence
  Synthetic oligonucleotide
tcaacactgctaaccttaga

SEQ ID NO: 61 - DNA, 20 bp, Artificial sequence
  Synthetic oligonucleotide
attcttcaacactgctaacc

SEQ ID NO: 62 - DNA, 20 bp, Artificial sequence
  Synthetic oligonucleotide
ttggcattcttcaacactgc

SEQ ID NO: 63 - DNA, 20 bp, Artificial sequence
  Synthetic oligonucleotide
ccttttttggcattcttcaa

SEQ ID NO: 64 - DNA, 20 bp, Artificial sequence
  Synthetic oligonucleotide
tggtgcaccttttttggcat

SEQ ID NO: 65 - DNA, 20 bp, Artificial sequence
  Synthetic oligonucleotide
cttcagtgagaatccagatt

SEQ ID NO: 66 - DNA, 20 bp, Artificial sequence
  Synthetic oligonucleotide
ggcacagggcttcagtgaga

SEQ ID NO: 67 - DNA, 20 bp, Artificial sequence
  Synthetic oligonucleotide
aatttctgaaagggcacagg

SEQ ID NO: 68 - DNA, 20 bp, Artificial sequence
  Synthetic oligonucleotide
caaccaatttctgaaagggc

SEQ ID NO: 69 - DNA, 20 bp, Artificial sequence
  Synthetic oligonucleotide
caagatgctggaagatgttc

SEQ ID NO: 70 - DNA, 20 bp, Artificial sequence
  Synthetic oligonucleotide
gtgccactttcagatgtttt

SEQ ID NO: 71 - DNA, 20 bp, Artificial sequence
  Synthetic oligonucleotide
ttggtgtgccactttcagat

SEQ ID NO: 72 - DNA, 20 bp, Artificial sequence
  Synthetic oligonucleotide
ggaacttggtgtgccacttt

SEQ ID NO: 73 - DNA, 20 bp, Artificial sequence
  Synthetic oligonucleotide
gtagaggaacttggtgtgcc

SEQ ID NO: 74 - DNA, 20 bp, Artificial sequence
  Synthetic oligonucleotide
gaggagtagaggaacttggt

SEQ ID NO: 75 - DNA, 20 bp, Artificial sequence
  Synthetic oligonucleotide
ttcttgaggagtagaggaac

SEQ ID NO: 76 - DNA, 20 bp, Artificial sequence
  Synthetic oligonucleotide
gtgttttcttgaggagtaga

SEQ ID NO: 77 - DNA, 20 bp, Artificial sequence
  Synthetic oligonucleotide
atatggtgttttcttgagga

SEQ ID NO: 78 - DNA, 20 bp, Artificial sequence
  Synthetic oligonucleotide
tccagatatggtgttttctt

SEQ ID NO: 79 - DNA, 20 bp, Artificial sequence
  Synthetic oligonucleotide
ctatatccagatatggtgtt

SEQ ID NO: 80 - DNA, 20 bp, Artificial sequence
  Synthetic oligonucleotide
ggttaaaaggctatatccag

SEQ ID NO: 81 - DNA, 20 bp, Artificial sequence
  Synthetic oligonucleotide
ttgcaggttaaaaggctata

SEQ ID NO: 82 - DNA, 20 bp, Artificial sequence
  Synthetic oligonucleotide
ttcttttgcaggttaaaagg

SEQ ID NO: 83 - DNA, 20 bp, Artificial sequence
  Synthetic oligonucleotide
taaagttcttttgcaggtta

SEQ ID NO: 84 - DNA, 20 bp, Artificial sequence
  Synthetic oligonucleotide
atggcagggttcaggtaaag

SEQ ID NO: 85 - DNA, 20 bp, Artificial sequence
  Synthetic oligonucleotide
ttagaatggcagggttcagg

SEQ ID NO: 86 - DNA, 20 bp, Artificial sequence
  Synthetic oligonucleotide
aaattttagaatggcagggt

SEQ ID NO: 87 - DNA, 20 bp, Artificial sequence
  Synthetic oligonucleotide
cgggtaaattttagaatggc

SEQ ID NO: 88 - DNA, 20 bp, Artificial sequence
  Synthetic oligonucleotide
actcccgggtaaattttaga

SEQ ID NO: 89 - DNA, 20 bp, Artificial sequence
  Synthetic oligonucleotide
tccaaagtcaactcccgggt

SEQ ID NO: 90 - DNA, 20 bp, Artificial sequence
  Synthetic oligonucleotide
tctcctccaaagtcaactcc

SEQ ID NO: 91 - DNA, 20 bp, Artificial sequence
  Synthetic oligonucleotide
attcttctcctccaaagtca

SEQ ID NO: 92 - DNA, 20 bp, Artificial sequence
  Synthetic oligonucleotide
attcaattcttctcctccaa

SEQ ID NO: 93 - DNA, 20 bp, Artificial sequence
  Synthetic oligonucleotide
gtcacattcaattcttctcc

SEQ ID NO: 94 - DNA, 20 bp, Artificial sequence
  Synthetic oligonucleotide
caaacattcactcctttaac

SEQ ID NO: 95 - DNA, 20 bp, Artificial sequence
  Synthetic oligonucleotide
cttggcaaacattcactcct

SEQ ID NO: 96 - DNA, 20 bp, Artificial sequence
  Synthetic oligonucleotide
agtctcttggcaaacattca

SEQ ID NO: 97 - DNA, 20 bp, Artificial sequence
  Synthetic oligonucleotide
tgacagcgaatcatctttgt

SEQ ID NO: 98 - DNA, 20 bp, Artificial sequence
  Synthetic oligonucleotide
aaaactgacagcgaatcatc

SEQ ID NO: 99 - DNA, 20 bp, Artificial sequence
  Synthetic oligonucleotide
agtgaaaaactgacagcgaa

SEQ ID NO: 100 - DNA, 20 bp, Artificial sequence
  Synthetic oligonucleotide
cagtcttctgggagtaaaga

SEQ ID NO: 101 - DNA, 20 bp, Artificial sequence
  Synthetic oligonucleotide
aagaaacacttacacttctc

SEQ ID NO: 102 - DNA, 20 bp, Artificial sequence
  Synthetic oligonucleotide
agataatcttaagaaacact

SEQ ID NO: 103 - DNA, 20 bp, Artificial sequence
  Synthetic oligonucleotide
gagctcccttgtgtcccata

SEQ ID NO: 104 - DNA, 20 bp, Artificial sequence
  Synthetic oligonucleotide
aaccagagctcccttgtgtc

SEQ ID NO: 105 - DNA, 20 bp, Artificial sequence
  Synthetic oligonucleotide
agagtaaccagagctccctt

SEQ ID NO: 106 - DNA, 20 bp, Artificial sequence
  Synthetic oligonucleotide
ctcaaagagtaaccagagct

SEQ ID NO: 107 - DNA, 20 bp, Artificial sequence
  Synthetic oligonucleotide
gcttgtttttgttgtgcaga

SEQ ID NO: 108 - DNA, 20 bp, Artificial sequence
  Synthetic oligonucleotide
acccaacagttggtataaat

SEQ ID NO: 109 - DNA, 20 bp, Artificial sequence
  Synthetic oligonucleotide
aggcatattggtttttggaa

SEQ ID NO: 110 - DNA, 20 bp, Artificial sequence
  Synthetic oligonucleotide
aacacaattgcttcttggag

SEQ ID NO: 111 - DNA, 20 bp, Artificial sequence
  Synthetic oligonucleotide
tgctggaagatgttcatgtg

SEQ ID NO: 112 - DNA, 20 bp, Artificial sequence
  Synthetic oligonucleotide
tttgttcctccaacaatgcg

SEQ ID NO: 113 - DNA, 20 bp, Artificial sequence
  Synthetic oligonucleotide
aagagtttgttcctccaaca

SEQ ID NO: 114 - DNA, 20 bp, Artificial sequence
  Synthetic oligonucleotide
ccaagaagagtttgttcctc

SEQ ID NO: 115 - DNA, 20 bp, Artificial sequence
  Synthetic oligonucleotide
tctccccaagaagagtttgt

SEQ ID NO: 116 - DNA, 20 bp, Artificial sequence
  Synthetic oligonucleotide
ccagggccactctccccaag

SEQ ID NO: 117 - DNA, 20 bp, Artificial sequence
  Synthetic oligonucleotide
agcttcacctgcaggctcac

SEQ ID NO: 118 - DNA, 20 bp, Artificial sequence
  Synthetic oligonucleotide
tatgagtgaccctccacaca

SEQ ID NO: 119 - DNA, 20 bp, Artificial sequence
  Synthetic oligonucleotide
tgtcctatgagtgaccctcc

SEQ ID NO: 120 - DNA, 20 bp, Artificial sequence
  Synthetic oligonucleotide
actggtgtcctatgagtgac

SEQ ID NO: 121 - DNA, 20 bp, Artificial sequence
  Synthetic oligonucleotide
gacccactggtgtcctatga

SEQ ID NO: 122 - DNA, 20 bp, Artificial sequence
  Synthetic oligonucleotide
gtgaggacccactggtgtcc

SEQ ID NO: 123 - DNA, 20 bp, Artificial sequence
  Synthetic oligonucleotide
aagcccatcaaagcagtggg

SEQ ID NO: 124 - DNA, 20 bp, Artificial sequence
  Synthetic oligonucleotide
gtctgacagatttaaaatgc

SEQ ID NO: 125 - DNA, 20 bp, Artificial sequence
  Synthetic oligonucleotide
gtaatgtctgacagatttaa

SEQ ID NO: 126 - DNA, 20 bp, Artificial sequence
  Synthetic oligonucleotide
cttttgtaatgtctgacaga

SEQ ID NO: 127 - DNA, 20 bp, Artificial sequence
  Synthetic oligonucleotide
tttatttgtgagaaaggtgt

SEQ ID NO: 128 - DNA, 20 bp, Artificial sequence
  Synthetic oligonucleotide
tctcttttatttgtgagaaa

SEQ ID NO: 129 - DNA, 20 bp, Artificial sequence
  Synthetic oligonucleotide
atcatgattcccttctgaga

SEQ ID NO: 130 - DNA, 20 bp, Artificial sequence
  Synthetic oligonucleotide
aaaggagcctggagttttat

SEQ ID NO: 131 - DNA, 20 bp, Artificial sequence
  Synthetic oligonucleotide
aattcaaaggagcctggagt

SEQ ID NO: 132 - DNA, 20 bp, Artificial sequence
  Synthetic oligonucleotide
agtgtaattcaaaggagcct

SEQ ID NO: 133 - DNA, 20 bp, Artificial sequence
  Synthetic oligonucleotide
aattcagtgtaattcaaagg

SEQ ID NO: 134 - DNA, 20 bp, Artificial sequence
  Synthetic oligonucleotide
tttggaattcagtgtaattc

SEQ ID NO: 135 - DNA, 20 bp, Artificial sequence
  Synthetic oligonucleotide
tggtttttggaattcagtgt

SEQ ID NO: 136 - DNA, 20 bp, Artificial sequence
  Synthetic oligonucleotide
attggtttttggaattcagt

SEQ ID NO: 137 - DNA, 20 bp, Artificial sequence
  Synthetic oligonucleotide
catattggtttttggaattc

SEQ ID NO: 138 - DNA, 20 bp, Artificial sequence
  Synthetic oligonucleotide
gtaggcatattggtttttgg

SEQ ID NO: 139 - DNA, 20 bp, Artificial sequence
  Synthetic oligonucleotide
gtgtcacctttggaaggtag

SEQ ID NO: 140 - DNA, 20 bp, Artificial sequence
  Synthetic oligonucleotide
aacagttggtataaattgtg

SEQ ID NO: 141 - DNA, 20 bp, Artificial sequence
  Synthetic oligonucleotide
caacagttggtataaattgt

SEQ ID NO: 142 - DNA, 20 bp, Artificial sequence
  Synthetic oligonucleotide
tacccaacagttggtataaa

SEQ ID NO: 143 - DNA, 20 bp, Artificial sequence
  Synthetic oligonucleotide
tccttcgagaagccccatcc

SEQ ID NO: 144 - DNA, 20 bp, Artificial sequence
  Synthetic oligonucleotide
aaaggaatatttaccttttg

SEQ ID NO: 145 - DNA, 20 bp, Artificial sequence
  Synthetic oligonucleotide
ttaccaaaggaatatttacc

SEQ ID NO: 146 - DNA, 20 bp, Artificial sequence
  Synthetic oligonucleotide
atttgttaccaaaggaatat

SEQ ID NO: 147 - DNA, 20 bp, Artificial sequence
  Synthetic oligonucleotide
ggcattcttcatttgttacc

SEQ ID NO: 148 - DNA, 20 bp, Artificial sequence
  Synthetic oligonucleotide
tttctggcattcttcatttg

SEQ ID NO: 149 - DNA, 20 bp, Artificial sequence
  Synthetic oligonucleotide
gatatcttttctggcattct

SEQ ID NO: 150 - DNA, 20 bp, Artificial sequence
  Synthetic oligonucleotide
atcttgatatcttttctggc

SEQ ID NO: 151 - DNA, 20 bp, Artificial sequence
  Synthetic oligonucleotide
ttataatcttgatatctttt

SEQ ID NO: 152 - DNA, 20 bp, Artificial sequence
  Synthetic oligonucleotide
ttattttataatcttgatat

SEQ ID NO: 153 - DNA, 20 bp, Artificial sequence
  Synthetic oligonucleotide
ttgggttattttataatctt

SEQ ID NO: 154 - DNA, 20 bp, Artificial sequence
  Synthetic oligonucleotide
atccgttgggttattttata

SEQ ID NO: 155 - DNA, 20 bp, Artificial sequence
  Synthetic oligonucleotide
agaccatccgttgggttatt

SEQ ID NO: 156 - DNA, 20 bp, Artificial sequence
  Synthetic oligonucleotide
agcacagaccatccgttggg

SEQ ID NO: 157 - DNA, 20 bp, Artificial sequence
  Synthetic oligonucleotide
ctttatagccagcacagacc

SEQ ID NO: 158 - DNA, 20 bp, Artificial sequence
  Synthetic oligonucleotide
cccttctttatagccagcac

SEQ ID NO: 159 - DNA, 20 bp, Artificial sequence
  Synthetic oligonucleotide
tttcccccttctttatagcc

SEQ ID NO: 160 - DNA, 20 bp, Artificial sequence
  Synthetic oligonucleotide
catcttttcccccttcttta

SEQ ID NO: 161 - DNA, 20 bp, Artificial sequence
  Synthetic oligonucleotide
cccttacaagcatcttttcc

SEQ ID NO: 162 - DNA, 20 bp, Artificial sequence
  Synthetic oligonucleotide
acattccattgtgtttgcaa

SEQ ID NO: 163 - DNA, 20 bp, Artificial sequence
  Synthetic oligonucleotide
tggtgatgcccaccaaacgc

SEQ ID NO: 164 - DNA, 20 bp, Artificial sequence
  Synthetic oligonucleotide
tgctccctgcgggcacagcc

SEQ ID NO: 165 - DNA, 20 bp, Artificial sequence
  Synthetic oligonucleotide
caggttgctccctgcgggca

SEQ ID NO: 166 - DNA, 20 bp, Artificial sequence
  Synthetic oligonucleotide
gacaccaggttgctccctgc

SEQ ID NO: 167 - DNA, 20 bp, Artificial sequence
  Synthetic oligonucleotide
gtgtagacaccaggttgctc

SEQ ID NO: 168 - DNA, 20 bp, Artificial sequence
  Synthetic oligonucleotide
ctttggtgtagacaccaggt

SEQ ID NO: 169 - DNA, 20 bp, Artificial sequence
  Synthetic oligonucleotide
agcgactttggtgtagacac

SEQ ID NO: 170 - DNA, 20 bp, Artificial sequence
  Synthetic oligonucleotide
tactcagcgactttggtgta

SEQ ID NO: 171 - DNA, 20 bp, Artificial sequence
  Synthetic oligonucleotide
ccatgtactcagcgactttg

SEQ ID NO: 172 - DNA, 20 bp, Artificial sequence
  Synthetic oligonucleotide
ccagtccatgtactcagcga

SEQ ID NO: 173 - DNA, 20 bp, Artificial sequence
  Synthetic oligonucleotide
ctgtgttttctctaaaatcc

SEQ ID NO: 174 - DNA, 20 bp, Artificial sequence
  Synthetic oligonucleotide
ctgctctgtgttttctctaa

SEQ ID NO: 175 - DNA, 20 bp, Artificial sequence
  Synthetic oligonucleotide
gctcagaatttgacttgaac

SEQ ID NO: 176 - DNA, 20 bp, Artificial sequence
  Synthetic oligonucleotide
cccaggctcagaatttgact

SEQ ID NO: 177 - DNA, 20 bp, Artificial sequence
  Synthetic oligonucleotide
ctttgcagatgaggaccccc

SEQ ID NO: 178 - DNA, 20 bp, Artificial sequence
  Synthetic oligonucleotide
ccatgctttgcagatgagga

SEQ ID NO: 179 - DNA, 20 bp, Artificial sequence
  Synthetic oligonucleotide
actctccatgctttgcagat

SEQ ID NO: 180 - DNA, 20 bp, Artificial sequence
  Synthetic oligonucleotide
atgccactctccatgctttg

SEQ ID NO: 181 - DNA, 20 bp, Artificial sequence
  Synthetic oligonucleotide
agcagctctgagtgcactgt

SEQ ID NO: 182 - DNA, 20 bp, Artificial sequence
  Synthetic oligonucleotide
tcctcagcagctctgagtgc

SEQ ID NO: 183 - DNA, 20 bp, Artificial sequence
  Synthetic oligonucleotide
cattgtcctcagcagctctg

SEQ ID NO: 184 - DNA, 20 bp, Artificial sequence
  Synthetic oligonucleotide
tggtttttggaattctgaaa

SEQ ID NO: 185 - DNA, 20 bp, Artificial sequence
  Synthetic oligonucleotide
atattggtttttggaattct

SEQ ID NO: 186 - DNA, 20 bp, Artificial sequence
  Synthetic oligonucleotide
tgtactagtttcctataact

SEQ ID NO: 187 - DNA, 20 bp, Artificial sequence
  Synthetic oligonucleotide
atagggacacaaccaaggaa

SEQ ID NO: 188 - DNA, 20 bp, Artificial sequence
  Synthetic oligonucleotide
aggcacagagccagcaccca

SEQ ID NO: 189 - DNA, 20 bp, Artificial sequence
  Synthetic oligonucleotide
cctgcctcctggcagccttc

SEQ ID NO: 190 - DNA, 20 bp, Artificial sequence
  Synthetic oligonucleotide
ccaggtgtggacagcagctg

SEQ ID NO: 191 - DNA, 20 bp, Artificial sequence
  Synthetic oligonucleotide
ggttttgtttgtaaaattag

SEQ ID NO: 192 - DNA, 20 bp, Artificial sequence
  Synthetic oligonucleotide
aaaacaccattaaatccatt

SEQ ID NO: 193 - DNA, 20 bp, Artificial sequence
  Synthetic oligonucleotide
acagaaaccatgatgttgct

SEQ ID NO: 194 - DNA, 20 bp, Artificial sequence
  Synthetic oligonucleotide
tcagcccaatgtcctaacct

SEQ ID NO: 195 - DNA, 20 bp, Artificial sequence
  Synthetic oligonucleotide
ccttcactgactctcttttc

SEQ ID NO: 196 - DNA, 20 bp, Artificial sequence
  Synthetic oligonucleotide
ttctcctggctcagaagctc

SEQ ID NO: 197 - DNA, 20 bp, Artificial sequence
  Synthetic oligonucleotide
gaatgtcaggcctctgggcc

SEQ ID NO: 198 - DNA, 20 bp, Artificial sequence
  Synthetic oligonucleotide
ctaacaaccccacaatatca

SEQ ID NO: 199 - DNA, 20 bp, Artificial sequence
  Synthetic oligonucleotide
cccaattcttagtcctttaa

SEQ ID NO: 200 - DNA, 20 bp, Artificial sequence
  Synthetic oligonucleotide
accaagctcagcctccaact

SEQ ID NO: 201 - DNA, 20 bp, Artificial sequence
  Synthetic oligonucleotide
ttattagtcaaatcacccaa

SEQ ID NO: 202 - DNA, 20 bp, Artificial sequence
  Synthetic oligonucleotide
tggatgggtagaggcctttc

SEQ ID NO: 203 - DNA, 20 bp, Artificial sequence
  Synthetic oligonucleotide
ccccctcccttccctacaca

SEQ ID NO: 204 - DNA, 20 bp, Artificial sequence
  Synthetic oligonucleotide
atgtaagttacaagccacta

SEQ ID NO: 205 - DNA, 20 bp, Artificial sequence
  Synthetic oligonucleotide
tgcctctttaataaaaactc

SEQ ID NO: 206 - DNA, 20 bp, Artificial sequence
  Synthetic oligonucleotide
actcattgccttaactcagg

SEQ ID NO: 207 - DNA, 20 bp, Artificial sequence
  Synthetic oligonucleotide
acttgaccttactgttttag

SEQ ID NO: 208 - DNA, 20 bp, Artificial sequence
  Synthetic oligonucleotide
ctcctccccaggctgctcct

SEQ ID NO: 209 - DNA, 20 bp, Artificial sequence
  Synthetic oligonucleotide
aagatctagataattcttgt

SEQ ID NO: 210 - DNA, 20 bp, Artificial sequence
  Synthetic oligonucleotide
tcaactcacacctgacctaa

SEQ ID NO: 211 - DNA, 20 bp, Artificial sequence
  Synthetic oligonucleotide
tgaacccaaaactctggcac

SEQ ID NO: 212 - DNA, 20 bp, Artificial sequence
  Synthetic oligonucleotide
agcccaaggaacatctcacc

SEQ ID NO: 213 - DNA, 20 bp, Artificial sequence
  Synthetic oligonucleotide
gcctgtttggtggtctcttc

SEQ ID NO: 214 - DNA, 20 bp, Artificial sequence
  Synthetic oligonucleotide
cttctcctggctcagaagct

SEQ ID NO: 215 - DNA, 20 bp, Artificial sequence
  Synthetic oligonucleotide
atgtatgattctaagaactt

SEQ ID NO: 216 - DNA, 20 bp, Artificial sequence
  Synthetic oligonucleotide
aacagacacattatttatat

SEQ ID NO: 217 - DNA, 20 bp, Artificial sequence
  Synthetic oligonucleotide
agagtcaagtccacagacat

SEQ ID NO: 218 - DNA, 20 bp, Artificial sequence
  Synthetic oligonucleotide
tcctaaataggaacaaagta

SEQ ID NO: 219 - DNA, 20 bp, Artificial sequence
  Synthetic oligonucleotide
ttgttaaggttgtagagaga

SEQ ID NO: 220 - DNA, 20 bp, Artificial sequence
  Synthetic oligonucleotide
acccaattatttttaatggc

SEQ ID NO: 221 - DNA, 20 bp, Artificial sequence
  Synthetic oligonucleotide
gcctaaatgtaagagctaaa

SEQ ID NO: 222 - DNA, 20 bp, Artificial sequence
  Synthetic oligonucleotide
taaactcttacatttataga

SEQ ID NO: 223 - DNA, 20 bp, Artificial sequence
  Synthetic oligonucleotide
aaataaaagcactcagactg

SEQ ID NO: 224 - DNA, 20 bp, Artificial sequence
  Synthetic oligonucleotide
ttggtctacagattcaatgc

SEQ ID NO: 225 - DNA, 20 bp, Artificial sequence
  Synthetic oligonucleotide
taacaaaaatgccttgtgcc

SEQ ID NO: 226 - DNA, 20 bp, Artificial sequence
  Synthetic oligonucleotide
tcccagctccagtcaccacc

SEQ ID NO: 227 - DNA, 20 bp, Artificial sequence
  Synthetic oligonucleotide
gtactaaacatcctaagtga

SEQ ID NO: 228 - DNA, 20 bp, Artificial sequence
  Synthetic oligonucleotide
actcgcctttgtgactcgat

SEQ ID NO: 229 - DNA, 20 bp, Artificial sequence
  Synthetic oligonucleotide
ttttgaatcttcattcaaag

SEQ ID NO: 230 - DNA, 20 bp, Artificial sequence
  Synthetic oligonucleotide
cagagccttgatcagaataa

SEQ ID NO: 231 - DNA, 20 bp, Artificial sequence
  Synthetic oligonucleotide
aagttccaccttctaactgg

SEQ ID NO: 232 - DNA, 20 bp, Artificial sequence
  Synthetic oligonucleotide
agcagctcacacccaaaaag

SEQ ID NO: 233 - DNA, 20 bp, Artificial sequence
  Synthetic oligonucleotide
ttctgtgtcaattataaaca

SEQ ID NO: 234 - DNA, 20 bp, Artificial sequence
  Synthetic oligonucleotide
tagaaagagtaagccttcac

SEQ ID NO: 235 - DNA, 20 bp, Artificial sequence
  Synthetic oligonucleotide
agtgaggttactcaccagag

SEQ ID NO: 236 - DNA, 20 bp, Artificial sequence
  Synthetic oligonucleotide
ttttgttgtgcagactgaaa

SEQ ID NO: 237 - DNA, 20 bp, Artificial sequence
  Synthetic oligonucleotide
ttacccatcaaagcagtggg

SEQ ID NO: 238 - DNA, 20 bp, Artificial sequence
  Synthetic oligonucleotide
aatgttgtgaataccatccc

SEQ ID NO: 239 - DNA, 20 bp, Artificial sequence
  Synthetic oligonucleotide
taacatttctatgggcctga

SEQ ID NO: 240 - DNA, 20 bp, Artificial sequence
  Synthetic oligonucleotide
tgtctactatttgaccaata

SEQ ID NO: 241 - DNA, 20 bp, Artificial sequence
  Synthetic oligonucleotide
tttaaatgtgtcacttaatc

SEQ ID NO: 242 - DNA, 20 bp, Artificial sequence
  Synthetic oligonucleotide
tcactaaaacaaaaatactt

SEQ ID NO: 243 - DNA, 20 bp, Artificial sequence
  Synthetic oligonucleotide
tcttccaggccaaccacctt

SEQ ID NO: 244 - DNA, 20 bp, Artificial sequence
  Synthetic oligonucleotide
tgcaaggcatgtgtgcacaa

SEQ ID NO: 245 - DNA, 20 bp, Artificial sequence
  Synthetic oligonucleotide
tgtttaaaatatctctatac

SEQ ID NO: 246 - DNA, 20 bp, Artificial sequence
  Synthetic oligonucleotide
catggaaaaattaagctcat

SEQ ID NO: 247 - DNA, 20 bp, Artificial sequence
  Synthetic oligonucleotide
tgaagattctatttaacaaa

SEQ ID NO: 248 - DNA, 20 bp, Artificial sequence
  Synthetic oligonucleotide
gcctaggagagaaaaataaa

SEQ ID NO: 249 - DNA, 20 bp, Artificial sequence
  Synthetic oligonucleotide
ccagtgtaattcaaaggagc

SEQ ID NO: 250 - DNA, 20 bp, Artificial sequence
  Synthetic oligonucleotide
ccattatttccatcacctgc

SEQ ID NO: 251 - DNA, 20 bp, Artificial sequence
  Synthetic oligonucleotide
tacccaaattatacctggaa

SEQ ID NO: 252 - DNA, 20 bp, Artificial sequence
  Synthetic oligonucleotide
agaggtaaagcaacttgccc

SEQ ID NO: 253 - DNA, 20 bp, Artificial sequence
  Synthetic oligonucleotide
tccttaatagtcatagcagg

SEQ ID NO: 254 - DNA, 20 bp, Artificial sequence
  Synthetic oligonucleotide
tcaccaccatttttcacatg

SEQ ID NO: 255 - DNA, 20 bp, Artificial sequence
  Synthetic oligonucleotide
gttatggatatagactttaa

SEQ ID NO: 256 - DNA, 20 bp, Artificial sequence
  Synthetic oligonucleotide
ctagaagcaatatttaaagc

SEQ ID NO: 257 - DNA, 20 bp, Artificial sequence
  Synthetic oligonucleotide
atgaagtaagatgcttaaaa

SEQ ID NO: 258 - DNA, 20 bp, Artificial sequence
  Synthetic oligonucleotide
cttcttgtctcagattacca

SEQ ID NO: 259 - DNA, 20 bp, Artificial sequence
  Synthetic oligonucleotide
tctgaaaagccctccgagct

SEQ ID NO: 260 - DNA, 20 bp, Artificial sequence
  Synthetic oligonucleotide
aagtgaatcagagcagtgta

SEQ ID NO: 261 - DNA, 20 bp, Artificial sequence
  Synthetic oligonucleotide
accttacaagcatcttttcc

SEQ ID NO: 262 - DNA, 20 bp, Artificial sequence
  Synthetic oligonucleotide
atttgttaaaagttgcttat

SEQ ID NO: 263 - DNA, 20 bp, Artificial sequence
  Synthetic oligonucleotide
tgatatcatcatcccaatga

SEQ ID NO: 264 - DNA, 20 bp, Artificial sequence
  Synthetic oligonucleotide
cagacaccttcttcacaagg

SEQ ID NO: 265 - DNA, 20 bp, Artificial sequence
  Synthetic oligonucleotide
aatttcccagatgtattagt

SEQ ID NO: 266 - DNA, 20 bp, Artificial sequence
  Synthetic oligonucleotide
tcagcagaaatcatgtaggc

SEQ ID NO: 267 - DNA, 20 bp, Artificial sequence
  Synthetic oligonucleotide
ttaaatataaagagatcctc

SEQ ID NO: 268 - DNA, 20 bp, Artificial sequence
  Synthetic oligonucleotide
gtaataaaaggaatgataaa

SEQ ID NO: 269 - DNA, 20 bp, Artificial sequence
  Synthetic oligonucleotide
agacagtaaacaaaatcagg

SEQ ID NO: 270 - DNA, 20 bp, Artificial sequence
  Synthetic oligonucleotide
caagaaaccaccaaaggaag

SEQ ID NO: 271 - DNA, 20 bp, Artificial sequence
  Synthetic oligonucleotide
accccaacagacagcccacc

SEQ ID NO: 272 - DNA, 20 bp, Artificial sequence
  Synthetic oligonucleotide
tgggctcaccccagtggacc

SEQ ID NO: 273 - DNA, 20 bp, Artificial sequence
  Synthetic oligonucleotide
gcctggcccccaagactcta

SEQ ID NO: 274 - DNA, 20 bp, Artificial sequence
  Synthetic oligonucleotide
aggcctgccacaggccagac

SEQ ID NO: 275 - DNA, 20 bp, Artificial sequence
  Synthetic oligonucleotide
ttcaagcctgggcagcacag

SEQ ID NO: 276 - DNA, 20 bp, Artificial sequence
  Synthetic oligonucleotide
aaaataacttcactagagct

SEQ ID NO: 277 - DNA, 20 bp, Artificial sequence
  Synthetic oligonucleotide
tgttaagtatattaactatt

SEQ ID NO: 278 - DNA, 20 bp, Artificial sequence
  Synthetic oligonucleotide
tactcaggaaattagaatat

SEQ ID NO: 279 - DNA, 20 bp, Artificial sequence
  Synthetic oligonucleotide
ttatgaaacctcttgatttg

SEQ ID NO: 280 - DNA, 20 bp, Artificial sequence
  Synthetic oligonucleotide
ttcttgtaaatgtctgaatt

SEQ ID NO: 281 - DNA, 20 bp, Artificial sequence
  Synthetic oligonucleotide
accacaggaaactgtagcaa

SEQ ID NO: 282 - DNA, 20 bp, Artificial sequence
  Synthetic oligonucleotide
gattggacccagacactata

SEQ ID NO: 283 - DNA, 20 bp, Artificial sequence
  Synthetic oligonucleotide
cctcttaagtcaccatagac

SEQ ID NO: 284 - DNA, 20 bp, Artificial sequence
  Synthetic oligonucleotide
ggttgagggacagacacagg

SEQ ID NO: 285 - DNA, 20 bp, Artificial sequence
  Synthetic oligonucleotide
ataatcatgatttattttgc

SEQ ID NO: 286 - DNA, 20 bp, Artificial sequence
  Synthetic oligonucleotide
cataagaatgtgcacacaaa

SEQ ID NO: 287 - DNA, 20 bp, Artificial sequence
  Synthetic oligonucleotide
actcttattagctggtagaa

SEQ ID NO: 288 - DNA, 20 bp, Artificial sequence
  Synthetic oligonucleotide
ggaccaaaactgagaggcag

SEQ ID NO: 289 - DNA, 20 bp, Artificial sequence
  Synthetic oligonucleotide
ccattactctcaagctccac

SEQ ID NO: 290 - DNA, 20 bp, Artificial sequence
  Synthetic oligonucleotide
atctattggttcaggagcca

SEQ ID NO: 291 - DNA, 20 bp, Artificial sequence
  Synthetic oligonucleotide
gttaaaacaactagaagcca

SEQ ID NO: 292 - DNA, 20 bp, Artificial sequence
  Synthetic oligonucleotide
aggtgttcttgcttatcctc

SEQ ID NO: 293 - DNA, 20 bp, Artificial sequence
  Synthetic oligonucleotide
gcagtcactcctcttccagc

SEQ ID NO: 294 - DNA, 20 bp, Artificial sequence
  Synthetic oligonucleotide
aagtgtattgcctagatttc

SEQ ID NO: 295 - DNA, 20 bp, Artificial sequence
  Synthetic oligonucleotide
gagtgccatcttctctgcac

SEQ ID NO: 296 - DNA, 20 bp, Artificial sequence
  Synthetic oligonucleotide
ttattcccagctctaaaata

SEQ ID NO: 297 - DNA, 20 bp, Artificial sequence
  Synthetic oligonucleotide
ctcacaattctgtaagggaa

SEQ ID NO: 298 - DNA, 20 bp, Artificial sequence
  Synthetic oligonucleotide
ataaaatatattaaggcaac

SEQ ID NO: 299 - DNA, 20 bp, Artificial sequence
  Synthetic oligonucleotide
ttgagtcagacatcctgtga

SEQ ID NO: 300 - DNA, 20 bp, Artificial sequence
  Synthetic oligonucleotide
taccttttctccatgtcatt

SEQ ID NO: 301 - DNA, 20 bp, Artificial sequence
  Synthetic oligonucleotide
gggattttgctgaagctggt

SEQ ID NO: 302 - DNA, 20 bp, Artificial sequence
  Synthetic oligonucleotide
ctttgaatagaaaatgacta

SEQ ID NO: 303 - DNA, 20 bp, Artificial sequence
  Synthetic oligonucleotide
caaaatcacaagttctagat

SEQ ID NO: 304 - DNA, 20 bp, Artificial sequence
  Synthetic oligonucleotide
tttccaatacttttacaaat

SEQ ID NO: 305 - DNA, 20 bp, Artificial sequence
  Synthetic oligonucleotide
attaataagcatctctctga

SEQ ID NO: 306 - DNA, 20 bp, Artificial sequence
  Synthetic oligonucleotide
tgactatccaatttctagtt

SEQ ID NO: 307 - DNA, 20 bp, Artificial sequence
  Synthetic oligonucleotide
cttgtagtctgcacttaatg

SEQ ID NO: 308 - DNA, 20 bp, Artificial sequence
  Synthetic oligonucleotide
acattttttaagtacaggaa

SEQ ID NO: 309 - DNA, 20 bp, Artificial sequence
  Synthetic oligonucleotide
gaaatgtctagcattttcta

SEQ ID NO: 310 - DNA, 20 bp, Artificial sequence
  Synthetic oligonucleotide
ccacttatttgatgaccaca

SEQ ID NO: 311 - DNA, 20 bp, Artificial sequence
  Synthetic oligonucleotide
tccagaatactgccccatct

SEQ ID NO: 312 - DNA, 20 bp, Artificial sequence
  Synthetic oligonucleotide
tggattcattttctgcaaat

SEQ ID NO: 313 - DNA, 20 bp, Artificial sequence
  Synthetic oligonucleotide
agacattgtcaaatgtcccc

SEQ ID NO: 314 - DNA, 20 bp, Artificial sequence
  Synthetic oligonucleotide
ttgatgtcagcactgttgac

SEQ ID NO: 315 - DNA, 20 bp, Artificial sequence
  Synthetic oligonucleotide
acatcagtagcttcagatgt

SEQ ID NO: 316 - DNA, 20 bp, Artificial sequence
  Synthetic oligonucleotide
caaaattaattgtgcataat

SEQ ID NO: 317 - DNA, 20 bp, Artificial sequence
  Synthetic oligonucleotide
tttttctttaaattttgcta

SEQ ID NO: 318 - DNA, 20 bp, Artificial sequence
  Synthetic oligonucleotide
tagagattttatgtacttgg

SEQ ID NO: 319 - DNA, 20 bp, Artificial sequence
  Synthetic oligonucleotide
aaacacaggaatttgcagac

SEQ ID NO: 320 - DNA, 20 bp, Artificial sequence
  Synthetic oligonucleotide
gtggaataaaccataatcta

SEQ ID NO: 321 - DNA, 20 bp, Artificial sequence
  Synthetic oligonucleotide
gataattcttttcacagaca

SEQ ID NO: 322 - DNA, 20 bp, Artificial sequence
  Synthetic oligonucleotide
cttctctatctcccagtgtt

SEQ ID NO: 323 - DNA, 20 bp, Artificial sequence
  Synthetic oligonucleotide
caatacaggtaaatttcacg

SEQ ID NO: 324 - DNA, 20 bp, Artificial sequence
  Synthetic oligonucleotide
aagggatttaaaatttttat

SEQ ID NO: 325 - DNA, 20 bp, Artificial sequence
  Synthetic oligonucleotide
ggcaagctgtacaagaaaaa

SEQ ID NO: 326 - DNA, 20 bp, Artificial sequence
  Synthetic oligonucleotide
tgtactcaccggtactctgc

SEQ ID NO: 327 - DNA, 20 bp, Artificial sequence
  Synthetic oligonucleotide
aagagaatgctcagaaatgg

SEQ ID NO: 328 - DNA, 20 bp, Artificial sequence
  Synthetic oligonucleotide
acacttgtaccccatacatc

SEQ ID NO: 329 - DNA, 20 bp, Artificial sequence
  Synthetic oligonucleotide
gacagtagagactgggaagg

SEQ ID NO: 330 - DNA, 20 bp, Artificial sequence
  Synthetic oligonucleotide
taccaatttctgaaagggca

SEQ ID NO: 331 - DNA, 20 bp, Artificial sequence
  Synthetic oligonucleotide
cagagtaaactccccatctc

SEQ ID NO: 332 - DNA, 20 bp, Artificial sequence
  Synthetic oligonucleotide
cttcaaagccagcagtgtaa

SEQ ID NO: 333 - DNA, 20 bp, Artificial sequence
  Synthetic oligonucleotide
cttactgggctaaaatcaag

SEQ ID NO: 334 - DNA, 20 bp, Artificial sequence
  Synthetic oligonucleotide
tatcactgtactagtttcct

SEQ ID NO: 335 - DNA, 20 bp, Artificial sequence
  Synthetic oligonucleotide
ctgtactagtttcctataac

SEQ ID NO: 336 - DNA, 20 bp, Artificial sequence
  Synthetic oligonucleotide
actgtactagtttcctataa

SEQ ID NO: 337 - DNA, 20 bp, Artificial sequence
  Synthetic oligonucleotide
cactgtactagtttcctata

SEQ ID NO: 338 - DNA, 20 bp, Artificial sequence
  Synthetic oligonucleotide
tcactgtactagtttcctat

SEQ ID NO: 339 - DNA, 20 bp, Artificial sequence
  Synthetic oligonucleotide
atcactgtactagtttccta

SEQ ID NO: 340 - DNA, 20 bp, Artificial sequence
  Synthetic oligonucleotide
gtggaatgtcatggcaattt

SEQ ID NO: 341 - DNA, 20 bp, Artificial sequence
  Synthetic oligonucleotide
atgaacggtcttcaagctgt

SEQ ID NO: 342 - DNA, 20 bp, Artificial sequence
  Synthetic oligonucleotide
aatgaacggtcttcaagctg

SEQ ID NO: 343 - DNA, 20 bp, Artificial sequence
  Synthetic oligonucleotide
aaaatgaacggtcttcaagc

SEQ ID NO: 344 - DNA, 20 bp, Artificial sequence
  Synthetic oligonucleotide
ttaaaaatgaacggtcttca

SEQ ID NO: 345 - DNA, 20 bp, Artificial sequence
  Synthetic oligonucleotide
cacttaaaaatgaacggtct

SEQ ID NO: 346 - DNA, 20 bp, Artificial sequence
  Synthetic oligonucleotide
tgagtctcttgtcacttaaa

SEQ ID NO: 347 - DNA, 20 bp, Artificial sequence
  Synthetic oligonucleotide
gaggtgagtctcttgtcact

SEQ ID NO: 348 - DNA, 20 bp, Artificial sequence
  Synthetic oligonucleotide
ggaggtgagtctcttgtcac

SEQ ID NO: 349 - DNA, 20 bp, Artificial sequence
  Synthetic oligonucleotide
ttggaggtgagtctcttgtc

SEQ ID NO: 350 - DNA, 20 bp, Artificial sequence
  Synthetic oligonucleotide
attgcttcttggaggtgagt

SEQ ID NO: 351 - DNA, 20 bp, Artificial sequence
  Synthetic oligonucleotide
caattgcttcttggaggtga

SEQ ID NO: 352 - DNA, 20 bp, Artificial sequence
  Synthetic oligonucleotide
cacaattgcttcttggaggt

SEQ ID NO: 353 - DNA, 20 bp, Artificial sequence
  Synthetic oligonucleotide
acacaattgcttcttggagg

SEQ ID NO: 354 - DNA, 20 bp, Artificial sequence
  Synthetic oligonucleotide
aaacacaattgcttcttgga

SEQ ID NO: 355 - DNA, 20 bp, Artificial sequence
  Synthetic oligonucleotide
aaaacacaattgcttcttgg

SEQ ID NO: 356 - DNA, 20 bp, Artificial sequence
  Synthetic oligonucleotide
gaaaacacaattgcttcttg

SEQ ID NO: 357 - DNA, 20 bp, Artificial sequence
  Synthetic oligonucleotide
ttgcttgaataaaatcattc

SEQ ID NO: 358 - DNA, 20 bp, Artificial sequence
  Synthetic oligonucleotide
gcttgcttgaataaaatcat

SEQ ID NO: 359 - DNA, 20 bp, Artificial sequence
  Synthetic oligonucleotide
ttgcttgcttgaataaaatc

SEQ ID NO: 360 - DNA, 20 bp, Artificial sequence
  Synthetic oligonucleotide
agttgcttgcttgaataaaa

SEQ ID NO: 361 - DNA, 20 bp, Artificial sequence
  Synthetic oligonucleotide
gaaataagttgcttgcttga

SEQ ID NO: 362 - DNA, 20 bp, Artificial sequence
  Synthetic oligonucleotide
aaatgaaataagttgcttgc

SEQ ID NO: 363 - DNA, 20 bp, Artificial sequence
  Synthetic oligonucleotide
actgtagcaaacaaggaaat

SEQ ID NO: 364 - DNA, 20 bp, Artificial sequence
  Synthetic oligonucleotide
ggaaactgtagcaaacaagg

SEQ ID NO: 365 - DNA, 20 bp, Artificial sequence
  Synthetic oligonucleotide
cacaggaaactgtagcaaac

SEQ ID NO: 366 - DNA, 20 bp, Artificial sequence
  Synthetic oligonucleotide
agacatccacaggaaactgt

SEQ ID NO: 367 - DNA, 20 bp, Artificial sequence
  Synthetic oligonucleotide
gtcagacatccacaggaaac

SEQ ID NO: 368 - DNA, 20 bp, Artificial sequence
  Synthetic oligonucleotide
tgagtcagacatccacagga

SEQ ID NO: 369 - DNA, 20 bp, Artificial sequence
  Synthetic oligonucleotide
catagagttgagtcagacat

SEQ ID NO: 370 - DNA, 20 bp, Artificial sequence
  Synthetic oligonucleotide
tcatagagttgagtcagaca

SEQ ID NO: 371 - DNA, 20 bp, Artificial sequence
  Synthetic oligonucleotide
ttcatagagttgagtcagac

SEQ ID NO: 372 - DNA, 20 bp, Artificial sequence
  Synthetic oligonucleotide
cgttttcatagagttgagtc

SEQ ID NO: 373 - DNA, 20 bp, Artificial sequence
  Synthetic oligonucleotide
ccccacctctgaagaaggcg

SEQ ID NO: 374 - DNA, 20 bp, Artificial sequence
  Synthetic oligonucleotide
catccccacctctgaagaag

SEQ ID NO: 375 - DNA, 20 bp, Artificial sequence
  Synthetic oligonucleotide
agctacatccccacctctga

SEQ ID NO: 376 - DNA, 20 bp, Artificial sequence
  Synthetic oligonucleotide
ggaagctacatccccacctc

SEQ ID NO: 377 - DNA, 20 bp, Artificial sequence
  Synthetic oligonucleotide
atggaagctacatccccacc

SEQ ID NO: 378 - DNA, 20 bp, Artificial sequence
  Synthetic oligonucleotide
tacatggaagctacatcccc

SEQ ID NO: 379 - DNA, 20 bp, Artificial sequence
  Synthetic oligonucleotide
gtacatggaagctacatccc

SEQ ID NO: 380 - DNA, 20 bp, Artificial sequence
  Synthetic oligonucleotide
gggtgtacatggaagctaca

SEQ ID NO: 381 - DNA, 20 bp, Artificial sequence
  Synthetic oligonucleotide
tggcagtattgggcatttgg

SEQ ID NO: 382 - DNA, 20 bp, Artificial sequence
  Synthetic oligonucleotide
catctggcagtattgggcat

SEQ ID NO: 383 - DNA, 20 bp, Artificial sequence
  Synthetic oligonucleotide
ctcatctggcagtattgggc

SEQ ID NO: 384 - DNA, 20 bp, Artificial sequence
  Synthetic oligonucleotide
cctcatctggcagtattggg

SEQ ID NO: 385 - DNA, 20 bp, Artificial sequence
  Synthetic oligonucleotide
acctcatctggcagtattgg

SEQ ID NO: 386 - DNA, 20 bp, Artificial sequence
  Synthetic oligonucleotide
tgcacctcatctggcagtat

SEQ ID NO: 387 - DNA, 20 bp, Artificial sequence
  Synthetic oligonucleotide
gaatgtgcacctcatctggc

SEQ ID NO: 388 - DNA, 20 bp, Artificial sequence
  Synthetic oligonucleotide
tggaatgtgcacctcatctg

SEQ ID NO: 389 - DNA, 20 bp, Artificial sequence
  Synthetic oligonucleotide
gggtggaatgtgcacctcat

SEQ ID NO: 390 - DNA, 20 bp, Artificial sequence
  Synthetic oligonucleotide
ttgggtggaatgtgcacctc

SEQ ID NO: 391 - DNA, 20 bp, Artificial sequence
  Synthetic oligonucleotide
cttgggtggaatgtgcacct

SEQ ID NO: 392 - DNA, 20 bp, Artificial sequence
  Synthetic oligonucleotide
tagcaaacaccttgggtgga

SEQ ID NO: 393 - DNA, 20 bp, Artificial sequence
  Synthetic oligonucleotide
actgaatagcaaacaccttg

SEQ ID NO: 394 - DNA, 20 bp, Artificial sequence
  Synthetic oligonucleotide
aaactgaatagcaaacacct

SEQ ID NO: 395 - DNA, 20 bp, Artificial sequence
  Synthetic oligonucleotide
acttgctggaagaaaactga

SEQ ID NO: 396 - DNA, 20 bp, Artificial sequence
  Synthetic oligonucleotide
gaacttgctggaagaaaact

SEQ ID NO: 397 - DNA, 20 bp, Artificial sequence
  Synthetic oligonucleotide
tgattgaacttgctggaaga

SEQ ID NO: 398 - DNA, 20 bp, Artificial sequence
  Synthetic oligonucleotide
cattgattgaacttgctgga

SEQ ID NO: 399 - DNA, 20 bp, Artificial sequence
  Synthetic oligonucleotide
tcattgattgaacttgctgg

SEQ ID NO: 400 - DNA, 20 bp, Artificial sequence
  Synthetic oligonucleotide
tgtcattgattgaacttgct

SEQ ID NO: 401 - DNA, 20 bp, Artificial sequence
  Synthetic oligonucleotide
ccatgtcattgattgaactt

SEQ ID NO: 402 - DNA, 20 bp, Artificial sequence
  Synthetic oligonucleotide
ctccatgtcattgattgaac

SEQ ID NO: 403 - DNA, 20 bp, Artificial sequence
  Synthetic oligonucleotide
ttctccatgtcattgattga

SEQ ID NO: 404 - DNA, 20 bp, Artificial sequence
  Synthetic oligonucleotide
cttttctccatgtcattgat

SEQ ID NO: 405 - DNA, 20 bp, Artificial sequence
  Synthetic oligonucleotide
accaaaccttttctccatgt

SEQ ID NO: 406 - DNA, 20 bp, Artificial sequence
  Synthetic oligonucleotide
gcaaccaaaccttttctcca

SEQ ID NO: 407 - DNA, 20 bp, Artificial sequence
  Synthetic oligonucleotide
agcaaccaaaccttttctcc

SEQ ID NO: 408 - DNA, 20 bp, Artificial sequence
  Synthetic oligonucleotide
gaagcaaccaaaccttttct

SEQ ID NO: 409 - DNA, 20 bp, Artificial sequence
  Synthetic oligonucleotide
tcaagaagcaaccaaacctt

SEQ ID NO: 410 - DNA, 20 bp, Artificial sequence
  Synthetic oligonucleotide
ctttcaagaagcaaccaaac

SEQ ID NO: 411 - DNA, 20 bp, Artificial sequence
  Synthetic oligonucleotide
atctttcaagaagcaaccaa

SEQ ID NO: 412 - DNA, 20 bp, Artificial sequence
  Synthetic oligonucleotide
ctatctttcaagaagcaacc

SEQ ID NO: 413 - DNA, 20 bp, Artificial sequence
  Synthetic oligonucleotide
cactatctttcaagaagcaa

SEQ ID NO: 414 - DNA, 20 bp, Artificial sequence
  Synthetic oligonucleotide
aacactatctttcaagaagc

SEQ ID NO: 415 - DNA, 20 bp, Artificial sequence
  Synthetic oligonucleotide
atgtacttttggcagggttc

SEQ ID NO: 416 - DNA, 20 bp, Artificial sequence
  Synthetic oligonucleotide
cgatgtacttttggcagggt

SEQ ID NO: 417 - DNA, 20 bp, Artificial sequence
  Synthetic oligonucleotide
gttcgatgtacttttggcag

SEQ ID NO: 418 - DNA, 20 bp, Artificial sequence
  Synthetic oligonucleotide
cctgttcgatgtacttttgg

SEQ ID NO: 419 - DNA, 20 bp, Artificial sequence
  Synthetic oligonucleotide
gcacctgttcgatgtacttt

SEQ ID NO: 420 - DNA, 20 bp, Artificial sequence
  Synthetic oligonucleotide
ctgcacctgttcgatgtact

SEQ ID NO: 421 - DNA, 20 bp, Artificial sequence
  Synthetic oligonucleotide
aactgcacctgttcgatgta

SEQ ID NO: 422 - DNA, 20 bp, Artificial sequence
  Synthetic oligonucleotide
gaaactgcacctgttcgatg

SEQ ID NO: 423 - DNA, 20 bp, Artificial sequence
  Synthetic oligonucleotide
cagaaactgcacctgttcga

SEQ ID NO: 424 - DNA, 20 bp, Artificial sequence
  Synthetic oligonucleotide
ccagaaactgcacctgttcg

SEQ ID NO: 425 - DNA, 20 bp, Artificial sequence
  Synthetic oligonucleotide
tgtccagaaactgcacctgt

SEQ ID NO: 426 - DNA, 20 bp, Artificial sequence
  Synthetic oligonucleotide
gaatgtccagaaactgcacc

SEQ ID NO: 427 - DNA, 20 bp, Artificial sequence
  Synthetic oligonucleotide
aggaatgtccagaaactgca

SEQ ID NO: 428 - DNA, 20 bp, Artificial sequence
  Synthetic oligonucleotide
tcaaggaatgtccagaaact

SEQ ID NO: 429 - DNA, 20 bp, Artificial sequence
  Synthetic oligonucleotide
cttcaaggaatgtccagaaa

SEQ ID NO: 430 - DNA, 20 bp, Artificial sequence
  Synthetic oligonucleotide
ttgcttcaaggaatgtccag

SEQ ID NO: 431 - DNA, 20 bp, Artificial sequence
  Synthetic oligonucleotide
cattgcttcaaggaatgtcc

SEQ ID NO: 432 - DNA, 20 bp, Artificial sequence
  Synthetic oligonucleotide
gaccacattgcttcaaggaa

SEQ ID NO: 433 - DNA, 20 bp, Artificial sequence
  Synthetic oligonucleotide
tgaccacattgcttcaagga

SEQ ID NO: 434 - DNA, 20 bp, Artificial sequence
  Synthetic oligonucleotide
atgaccacattgcttcaagg

SEQ ID NO: 435 - DNA, 20 bp, Artificial sequence
  Synthetic oligonucleotide
ttgatgaccacattgcttca

SEQ ID NO: 436 - DNA, 20 bp, Artificial sequence
  Synthetic oligonucleotide
atttgatgaccacattgctt

SEQ ID NO: 437 - DNA, 20 bp, Artificial sequence
  Synthetic oligonucleotide
ttatttgatgaccacattgc

SEQ ID NO: 438 - DNA, 20 bp, Artificial sequence
  Synthetic oligonucleotide
cttatttgatgaccacattg

SEQ ID NO: 439 - DNA, 20 bp, Artificial sequence
  Synthetic oligonucleotide
cacttatttgatgaccacat

SEQ ID NO: 440 - DNA, 20 bp, Artificial sequence
  Synthetic oligonucleotide
agcacttatttgatgaccac

SEQ ID NO: 441 - DNA, 20 bp, Artificial sequence
  Synthetic oligonucleotide
caagcacttatttgatgacc

SEQ ID NO: 442 - DNA, 20 bp, Artificial sequence
  Synthetic oligonucleotide
cgatggcaagcacttatttg

SEQ ID NO: 443 - DNA, 20 bp, Artificial sequence
  Synthetic oligonucleotide
tgtctcgatggcaagcactt

SEQ ID NO: 444 - DNA, 20 bp, Artificial sequence
  Synthetic oligonucleotide
atgtctcgatggcaagcact

SEQ ID NO: 445 - DNA, 20 bp, Artificial sequence
  Synthetic oligonucleotide
aatgtctcgatggcaagcac

SEQ ID NO: 446 - DNA, 20 bp, Artificial sequence
  Synthetic oligonucleotide
ttataaatgtctcgatggca

SEQ ID NO: 447 - DNA, 20 bp, Artificial sequence
  Synthetic oligonucleotide
tttataaatgtctcgatggc

SEQ ID NO: 448 - DNA, 20 bp, Artificial sequence
  Synthetic oligonucleotide
ctcctttataaatgtctcga

SEQ ID NO: 449 - DNA, 20 bp, Artificial sequence
  Synthetic oligonucleotide
aactcctttataaatgtctc

SEQ ID NO: 450 - DNA, 20 bp, Artificial sequence
  Synthetic oligonucleotide
tcaactcctttataaatgtc

SEQ ID NO: 451 - DNA, 20 bp, Artificial sequence
  Synthetic oligonucleotide
tatcaactcctttataaatg

SEQ ID NO: 452 - DNA, 20 bp, Artificial sequence
  Synthetic oligonucleotide
ctctcatatcaactccttta

SEQ ID NO: 453 - DNA, 20 bp, Artificial sequence
  Synthetic oligonucleotide
ctcctctcatatcaactcct

SEQ ID NO: 454 - DNA, 20 bp, Artificial sequence
  Synthetic oligonucleotide
gactcctctcatatcaactc

SEQ ID NO: 455 - DNA, 20 bp, Artificial sequence
  Synthetic oligonucleotide
aattgactcctctcatatca

SEQ ID NO: 456 - DNA, 20 bp, Artificial sequence
  Synthetic oligonucleotide
attaaaattgactcctctca

SEQ ID NO: 457 - DNA, 20 bp, Artificial sequence
  Synthetic oligonucleotide
cattaaaattgactcctctc

SEQ ID NO: 458 - DNA, 20 bp, Artificial sequence
  Synthetic oligonucleotide
cacattaaaattgactcctc

SEQ ID NO: 459 - DNA, 20 bp, Artificial sequence
  Synthetic oligonucleotide
gacacattaaaattgactcc

SEQ ID NO: 460 - DNA, 20 bp, Artificial sequence
  Synthetic oligonucleotide
agacacattaaaattgactc

SEQ ID NO: 461 - DNA, 20 bp, Artificial sequence
  Synthetic oligonucleotide
accttagacacattaaaatt

SEQ ID NO: 462 - DNA, 20 bp, Artificial sequence
  Synthetic oligonucleotide
gctaaccttagacacattaa

SEQ ID NO: 463 - DNA, 20 bp, Artificial sequence
  Synthetic oligonucleotide
actgctaaccttagacacat

SEQ ID NO: 464 - DNA, 20 bp, Artificial sequence
  Synthetic oligonucleotide
cactgctaaccttagacaca

SEQ ID NO: 465 - DNA, 20 bp, Artificial sequence
  Synthetic oligonucleotide
acactgctaaccttagacac

SEQ ID NO: 466 - DNA, 20 bp, Artificial sequence
  Synthetic oligonucleotide
cttcaacactgctaacctta

SEQ ID NO: 467 - DNA, 20 bp, Artificial sequence
  Synthetic oligonucleotide
tcttcaacactgctaacctt

SEQ ID NO: 468 - DNA, 20 bp, Artificial sequence
  Synthetic oligonucleotide
ggcattcttcaacactgcta

SEQ ID NO: 469 - DNA, 20 bp, Artificial sequence
  Synthetic oligonucleotide
tggcattcttcaacactgct

SEQ ID NO: 470 - DNA, 20 bp, Artificial sequence
  Synthetic oligonucleotide
tttggcattcttcaacactg

SEQ ID NO: 471 - DNA, 20 bp, Artificial sequence
  Synthetic oligonucleotide
aaaactggcagcgaatgtta

SEQ ID NO: 472 - DNA, 20 bp, Artificial sequence
  Synthetic oligonucleotide
ccggtactctgccttgtgaa

SEQ ID NO: 473 - DNA, 20 bp, Artificial sequence
  Synthetic oligonucleotide
attgttccggtactctgcct

SEQ ID NO: 474 - DNA, 20 bp, Artificial sequence
  Synthetic oligonucleotide
aattgttccggtactctgcc

SEQ ID NO: 475 - DNA, 20 bp, Artificial sequence
  Synthetic oligonucleotide
caattgttccggtactctgc

SEQ ID NO: 476 - DNA, 20 bp, Artificial sequence
  Synthetic oligonucleotide
aataggcaattgttccggta

SEQ ID NO: 477 - DNA, 20 bp, Artificial sequence
  Synthetic oligonucleotide
taataggcaattgttccggt

SEQ ID NO: 478 - DNA, 20 bp, Artificial sequence
  Synthetic oligonucleotide
ctttaataggcaattgttcc

SEQ ID NO: 479 - DNA, 20 bp, Artificial sequence
  Synthetic oligonucleotide
gtactttaataggcaattgt

SEQ ID NO: 480 - DNA, 20 bp, Artificial sequence
  Synthetic oligonucleotide
cgggactgtactttaatagg

SEQ ID NO: 481 - DNA, 20 bp, Artificial sequence
  Synthetic oligonucleotide
cgttactcagcacctttata

SEQ ID NO: 482 - DNA, 20 bp, Artificial sequence
  Synthetic oligonucleotide
gcttcagtgagaatccagat

SEQ ID NO: 483 - DNA, 20 bp, Artificial sequence
  Synthetic oligonucleotide
ccaatttctgaaagggcaca

SEQ ID NO: 484 - DNA, 20 bp, Artificial sequence
  Synthetic oligonucleotide
aaccaatttctgaaagggca

SEQ ID NO: 485 - DNA, 20 bp, Artificial sequence
  Synthetic oligonucleotide
gcaaccaatttctgaaaggg

SEQ ID NO: 486 - DNA, 20 bp, Artificial sequence
  Synthetic oligonucleotide
ggcaaccaatttctgaaagg

SEQ ID NO: 487 - DNA, 20 bp, Artificial sequence
  Synthetic oligonucleotide
agatgctggaagatgttcat

SEQ ID NO: 488 - DNA, 20 bp, Artificial sequence
  Synthetic oligonucleotide
caacatccacatctgagaac

SEQ ID NO: 489 - DNA, 20 bp, Artificial sequence
  Synthetic oligonucleotide
ggcaacatccacatctgaga

SEQ ID NO: 490 - DNA, 20 bp, Artificial sequence
  Synthetic oligonucleotide
ccctggcaacatccacatct

SEQ ID NO: 491 - DNA, 20 bp, Artificial sequence
  Synthetic oligonucleotide
gaaccctggcaacatccaca

SEQ ID NO: 492 - DNA, 20 bp, Artificial sequence
  Synthetic oligonucleotide
gagaaccctggcaacatcca

SEQ ID NO: 493 - DNA, 20 bp, Artificial sequence
  Synthetic oligonucleotide
tgagaaccctggcaacatcc

SEQ ID NO: 494 - DNA, 20 bp, Artificial sequence
  Synthetic oligonucleotide
ggagtgagaaccctggcaac

SEQ ID NO: 495 - DNA, 20 bp, Artificial sequence
  Synthetic oligonucleotide
ctggagtgagaaccctggca

SEQ ID NO: 496 - DNA, 20 bp, Artificial sequence
  Synthetic oligonucleotide
atctggagtgagaaccctgg

SEQ ID NO: 497 - DNA, 20 bp, Artificial sequence
  Synthetic oligonucleotide
gcatctggagtgagaaccct

SEQ ID NO: 498 - DNA, 20 bp, Artificial sequence
  Synthetic oligonucleotide
aagcatctggagtgagaacc

SEQ ID NO: 499 - DNA, 20 bp, Artificial sequence
  Synthetic oligonucleotide
caaaagcatctggagtgaga

SEQ ID NO: 500 - DNA, 20 bp, Artificial sequence
  Synthetic oligonucleotide
cacaaaagcatctggagtga

SEQ ID NO: 501 - DNA, 20 bp, Artificial sequence
  Synthetic oligonucleotide
tggtccgacacacaaaagca

SEQ ID NO: 502 - DNA, 20 bp, Artificial sequence
  Synthetic oligonucleotide
atggtccgacacacaaaagc

SEQ ID NO: 503 - DNA, 20 bp, Artificial sequence
  Synthetic oligonucleotide
gatggtccgacacacaaaag

SEQ ID NO: 504 - DNA, 20 bp, Artificial sequence
  Synthetic oligonucleotide
gcagatggtccgacacacaa

SEQ ID NO: 505 - DNA, 20 bp, Artificial sequence
  Synthetic oligonucleotide
taggtgcagatggtccgaca

SEQ ID NO: 506 - DNA, 20 bp, Artificial sequence
  Synthetic oligonucleotide
gataggtgcagatggtccga

SEQ ID NO: 507 - DNA, 20 bp, Artificial sequence
  Synthetic oligonucleotide
gtgataggtgcagatggtcc

SEQ ID NO: 508 - DNA, 20 bp, Artificial sequence
  Synthetic oligonucleotide
gggtgataggtgcagatggt

SEQ ID NO: 509 - DNA, 20 bp, Artificial sequence
  Synthetic oligonucleotide
gaatgtaaagaagaggcagt

SEQ ID NO: 510 - DNA, 20 bp, Artificial sequence
  Synthetic oligonucleotide
tagaatgtaaagaagaggca

SEQ ID NO: 511 - DNA, 20 bp, Artificial sequence
  Synthetic oligonucleotide
catttgtatagaatgtaaag

SEQ ID NO: 512 - DNA, 20 bp, Artificial sequence
  Synthetic oligonucleotide
tacatttgtatagaatgtaa

SEQ ID NO: 513 - DNA, 20 bp, Artificial sequence
  Synthetic oligonucleotide
ccatacatttgtatagaatg

SEQ ID NO: 514 - DNA, 20 bp, Artificial sequence
  Synthetic oligonucleotide
ctcgattttccatacatttg

SEQ ID NO: 515 - DNA, 20 bp, Artificial sequence
  Synthetic oligonucleotide
tgactcgattttccatacat

SEQ ID NO: 516 - DNA, 20 bp, Artificial sequence
  Synthetic oligonucleotide
gtgactcgattttccataca

SEQ ID NO: 517 - DNA, 20 bp, Artificial sequence
  Synthetic oligonucleotide
tgtgactcgattttccatac

SEQ ID NO: 518 - DNA, 20 bp, Artificial sequence
  Synthetic oligonucleotide
ctttgtgactcgattttcca

SEQ ID NO: 519 - DNA, 20 bp, Artificial sequence
  Synthetic oligonucleotide
ttctttgtgactcgattttc

SEQ ID NO: 520 - DNA, 20 bp, Artificial sequence
  Synthetic oligonucleotide
acatttctttgtgactcgat

SEQ ID NO: 521 - DNA, 20 bp, Artificial sequence
  Synthetic oligonucleotide
aaacatttctttgtgactcg

SEQ ID NO: 522 - DNA, 20 bp, Artificial sequence
  Synthetic oligonucleotide
tgtgccactttcagatgttt

SEQ ID NO: 523 - DNA, 20 bp, Artificial sequence
  Synthetic oligonucleotide
gtgtgccactttcagatgtt

SEQ ID NO: 524 - DNA, 20 bp, Artificial sequence
  Synthetic oligonucleotide
cttggtgtgccactttcaga

SEQ ID NO: 525 - DNA, 20 bp, Artificial sequence
  Synthetic oligonucleotide
acttggtgtgccactttcag

SEQ ID NO: 526 - DNA, 20 bp, Artificial sequence
  Synthetic oligonucleotide
aggaacttggtgtgccactt

SEQ ID NO: 527 - DNA, 20 bp, Artificial sequence
  Synthetic oligonucleotide
tggtgttttcttgaggagta

SEQ ID NO: 528 - DNA, 20 bp, Artificial sequence
  Synthetic oligonucleotide
atggtgttttcttgaggagt

SEQ ID NO: 529 - DNA, 20 bp, Artificial sequence
  Synthetic oligonucleotide
tatggtgttttcttgaggag

SEQ ID NO: 530 - DNA, 20 bp, Artificial sequence
  Synthetic oligonucleotide
cagatatggtgttttcttga

SEQ ID NO: 531 - DNA, 20 bp, Artificial sequence
  Synthetic oligonucleotide
ccagatatggtgttttcttg

SEQ ID NO: 532 - DNA, 20 bp, Artificial sequence
  Synthetic oligonucleotide
atccagatatggtgttttct

SEQ ID NO: 533 - DNA, 20 bp, Artificial sequence
  Synthetic oligonucleotide
atatccagatatggtgtttt

SEQ ID NO: 534 - DNA, 20 bp, Artificial sequence
  Synthetic oligonucleotide
ggctatatccagatatggtg

SEQ ID NO: 535 - DNA, 20 bp, Artificial sequence
  Synthetic oligonucleotide
aaggctatatccagatatgg

SEQ ID NO: 536 - DNA, 20 bp, Artificial sequence
  Synthetic oligonucleotide
gttaaaaggctatatccaga

SEQ ID NO: 537 - DNA, 20 bp, Artificial sequence
  Synthetic oligonucleotide
caggttaaaaggctatatcc

SEQ ID NO: 538 - DNA, 20 bp, Artificial sequence
  Synthetic oligonucleotide
tgcaggttaaaaggctatat

SEQ ID NO: 539 - DNA, 20 bp, Artificial sequence
  Synthetic oligonucleotide
tttgcaggttaaaaggctat

SEQ ID NO: 540 - DNA, 20 bp, Artificial sequence
  Synthetic oligonucleotide
cttttgcaggttaaaaggct

SEQ ID NO: 541 - DNA, 20 bp, Artificial sequence
  Synthetic oligonucleotide
gttcttttgcaggttaaaag

SEQ ID NO: 542 - DNA, 20 bp, Artificial sequence
  Synthetic oligonucleotide
aagttcttttgcaggttaaa

SEQ ID NO: 543 - DNA, 20 bp, Artificial sequence
  Synthetic oligonucleotide
gtaaagttcttttgcaggtt

SEQ ID NO: 544 - DNA, 20 bp, Artificial sequence
  Synthetic oligonucleotide
caggtaaagttcttttgcag

SEQ ID NO: 545 - DNA, 20 bp, Artificial sequence
  Synthetic oligonucleotide
tcaggtaaagttcttttgca

SEQ ID NO: 546 - DNA, 20 bp, Artificial sequence
  Synthetic oligonucleotide
gttcaggtaaagttcttttg

SEQ ID NO: 547 - DNA, 20 bp, Artificial sequence
  Synthetic oligonucleotide
gggttcaggtaaagttcttt

SEQ ID NO: 548 - DNA, 20 bp, Artificial sequence
  Synthetic oligonucleotide
cagggttcaggtaaagttct

SEQ ID NO: 549 - DNA, 20 bp, Artificial sequence
  Synthetic oligonucleotide
gcagggttcaggtaaagttc

SEQ ID NO: 550 - DNA, 20 bp, Artificial sequence
  Synthetic oligonucleotide
tggcagggttcaggtaaagt

SEQ ID NO: 551 - DNA, 20 bp, Artificial sequence
  Synthetic oligonucleotide
gaatggcagggttcaggtaa

SEQ ID NO: 552 - DNA, 20 bp, Artificial sequence
  Synthetic oligonucleotide
agaatggcagggttcaggta

SEQ ID NO: 553 - DNA, 20 bp, Artificial sequence
  Synthetic oligonucleotide
tttagaatggcagggttcag

SEQ ID NO: 554 - DNA, 20 bp, Artificial sequence
  Synthetic oligonucleotide
attttagaatggcagggttc

SEQ ID NO: 555 - DNA, 20 bp, Artificial sequence
  Synthetic oligonucleotide
taaattttagaatggcaggg

SEQ ID NO: 556 - DNA, 20 bp, Artificial sequence
  Synthetic oligonucleotide
agtcaactcccgggtaaatt

SEQ ID NO: 557 - DNA, 20 bp, Artificial sequence
  Synthetic oligonucleotide
caaagtcaactcccgggtaa

SEQ ID NO: 558 - DNA, 20 bp, Artificial sequence
  Synthetic oligonucleotide
ccaaagtcaactcccgggta

SEQ ID NO: 559 - DNA, 20 bp, Artificial sequence
  Synthetic oligonucleotide
cctccaaagtcaactcccgg

SEQ ID NO: 560 - DNA, 20 bp, Artificial sequence
  Synthetic oligonucleotide
ctcctccaaagtcaactccc

SEQ ID NO: 561 - DNA, 20 bp, Artificial sequence
  Synthetic oligonucleotide
cttctcctccaaagtcaact

SEQ ID NO: 562 - DNA, 20 bp, Artificial sequence
  Synthetic oligonucleotide
ttcaattcttctcctccaaa

SEQ ID NO: 563 - DNA, 20 bp, Artificial sequence
  Synthetic oligonucleotide
cattcaattcttctcctcca

SEQ ID NO: 564 - DNA, 20 bp, Artificial sequence
  Synthetic oligonucleotide
tcacattcaattcttctcct

SEQ ID NO: 565 - DNA, 20 bp, Artificial sequence
  Synthetic oligonucleotide
agtcacattcaattcttctc

SEQ ID NO: 566 - DNA, 20 bp, Artificial sequence
  Synthetic oligonucleotide
ggcaaacattcactccttta

SEQ ID NO: 567 - DNA, 20 bp, Artificial sequence
  Synthetic oligonucleotide
tcttggcaaacattcactcc

SEQ ID NO: 568 - DNA, 20 bp, Artificial sequence
  Synthetic oligonucleotide
gtctcttggcaaacattcac

SEQ ID NO: 569 - DNA, 20 bp, Artificial sequence
  Synthetic oligonucleotide
caagtctcttggcaaacatt

SEQ ID NO: 570 - DNA, 20 bp, Artificial sequence
  Synthetic oligonucleotide
tgcaagtctcttggcaaaca

SEQ ID NO: 571 - DNA, 20 bp, Artificial sequence
  Synthetic oligonucleotide
ctttgtgcaagtctcttggc

SEQ ID NO: 572 - DNA, 20 bp, Artificial sequence
  Synthetic oligonucleotide
catctttgtgcaagtctctt

SEQ ID NO: 573 - DNA, 20 bp, Artificial sequence
  Synthetic oligonucleotide
tcatctttgtgcaagtctct

SEQ ID NO: 574 - DNA, 20 bp, Artificial sequence
  Synthetic oligonucleotide
atcatctttgtgcaagtctc

SEQ ID NO: 575 - DNA, 20 bp, Artificial sequence
  Synthetic oligonucleotide
acagcgaatcatctttgtgc

SEQ ID NO: 576 - DNA, 20 bp, Artificial sequence
  Synthetic oligonucleotide
actgacagcgaatcatcttt

SEQ ID NO: 577 - DNA, 20 bp, Artificial sequence
  Synthetic oligonucleotide
gaaaaactgacagcgaatca

SEQ ID NO: 578 - DNA, 20 bp, Artificial sequence
  Synthetic oligonucleotide
gtgaaaaactgacagcgaat

SEQ ID NO: 579 - DNA, 20 bp, Artificial sequence
  Synthetic oligonucleotide
ggagtaaagaataagtgaaa

SEQ ID NO: 580 - DNA, 20 bp, Artificial sequence
  Synthetic oligonucleotide
tgggagtaaagaataagtga

SEQ ID NO: 581 - DNA, 20 bp, Artificial sequence
  Synthetic oligonucleotide
tctgggagtaaagaataagt

SEQ ID NO: 582 - DNA, 20 bp, Artificial sequence
  Synthetic oligonucleotide
gtcttctgggagtaaagaat

SEQ ID NO: 583 - DNA, 20 bp, Artificial sequence
  Synthetic oligonucleotide
acagtcttctgggagtaaag

SEQ ID NO: 584 - DNA, 20 bp, Artificial sequence
  Synthetic oligonucleotide
cttacagtcttctgggagta

SEQ ID NO: 585 - DNA, 20 bp, Artificial sequence
  Synthetic oligonucleotide
ccttacagtcttctgggagt

SEQ ID NO: 586 - DNA, 20 bp, Artificial sequence
  Synthetic oligonucleotide
tccttacagtcttctgggag

SEQ ID NO: 587 - DNA, 20 bp, Artificial sequence
  Synthetic oligonucleotide
cttccttacagtcttctggg

SEQ ID NO: 588 - DNA, 20 bp, Artificial sequence
  Synthetic oligonucleotide
cacttacacttctcttcctt

SEQ ID NO: 589 - DNA, 20 bp, Artificial sequence
  Synthetic oligonucleotide
acacttacacttctcttcct

SEQ ID NO: 590 - DNA, 20 bp, Artificial sequence
  Synthetic oligonucleotide
agaaacacttacacttctct

SEQ ID NO: 591 - DNA, 20 bp, Artificial sequence
  Synthetic oligonucleotide
cttaagaaacacttacactt

SEQ ID NO: 592 - DNA, 20 bp, Artificial sequence
  Synthetic oligonucleotide
ccatagataatcttaagaaa

SEQ ID NO: 593 - DNA, 20 bp, Artificial sequence
  Synthetic oligonucleotide
catccatagataatcttaag

SEQ ID NO: 594 - DNA, 20 bp, Artificial sequence
  Synthetic oligonucleotide
accatccatagataatctta

SEQ ID NO: 595 - DNA, 20 bp, Artificial sequence
  Synthetic oligonucleotide
gaaccatccatagataatct

SEQ ID NO: 596 - DNA, 20 bp, Artificial sequence
  Synthetic oligonucleotide
tggagaaccatccatagata

SEQ ID NO: 597 - DNA, 20 bp, Artificial sequence
  Synthetic oligonucleotide
tgtgtcccatacgcaatcct

SEQ ID NO: 598 - DNA, 20 bp, Artificial sequence
  Synthetic oligonucleotide
cccttgtgtcccatacgcaa

SEQ ID NO: 599 - DNA, 20 bp, Artificial sequence
  Synthetic oligonucleotide
gctcccttgtgtcccatacg

SEQ ID NO: 600 - DNA, 20 bp, Artificial sequence
  Synthetic oligonucleotide
agagctcccttgtgtcccat

SEQ ID NO: 601 - DNA, 20 bp, Artificial sequence
  Synthetic oligonucleotide
ccagagctcccttgtgtccc

SEQ ID NO: 602 - DNA, 20 bp, Artificial sequence
  Synthetic oligonucleotide
taaccagagctcccttgtgt

SEQ ID NO: 603 - DNA, 20 bp, Artificial sequence
  Synthetic oligonucleotide
gtaaccagagctcccttgtg

SEQ ID NO: 604 - DNA, 20 bp, Artificial sequence
  Synthetic oligonucleotide
gagtaaccagagctcccttg

SEQ ID NO: 605 - DNA, 20 bp, Artificial sequence
  Synthetic oligonucleotide
aagagtaaccagagctccct

SEQ ID NO: 606 - DNA, 20 bp, Artificial sequence
  Synthetic oligonucleotide
tcaaagagtaaccagagctc

SEQ ID NO: 607 - DNA, 20 bp, Artificial sequence
  Synthetic oligonucleotide
tctcaaagagtaaccagagc

SEQ ID NO: 608 - DNA, 20 bp, Artificial sequence
  Synthetic oligonucleotide
aatctcaaagagtaaccaga

SEQ ID NO: 609 - DNA, 20 bp, Artificial sequence
  Synthetic oligonucleotide
caatctcaaagagtaaccag

SEQ ID NO: 610 - DNA, 20 bp, Artificial sequence
  Synthetic oligonucleotide
cacaatctcaaagagtaacc

SEQ ID NO: 611 - DNA, 20 bp, Artificial sequence
  Synthetic oligonucleotide
gttacacaatctcaaagagt

SEQ ID NO: 612 - DNA, 20 bp, Artificial sequence
  Synthetic oligonucleotide
cagtgttacacaatctcaaa

SEQ ID NO: 613 - DNA, 20 bp, Artificial sequence
  Synthetic oligonucleotide
cccagtgttacacaatctca

SEQ ID NO: 614 - DNA, 20 bp, Artificial sequence
  Synthetic oligonucleotide
gtccccagtgttacacaatc

SEQ ID NO: 615 - DNA, 20 bp, Artificial sequence
  Synthetic oligonucleotide
gttgtccccagtgttacaca

SEQ ID NO: 616 - DNA, 20 bp, Artificial sequence
  Synthetic oligonucleotide
gtttgttcctccaacaatgc

SEQ ID NO: 617 - DNA, 20 bp, Artificial sequence
  Synthetic oligonucleotide
agagtttgttcctccaacaa

SEQ ID NO: 618 - DNA, 20 bp, Artificial sequence
  Synthetic oligonucleotide
caagaagagtttgttcctcc

SEQ ID NO: 619 - DNA, 20 bp, Artificial sequence
  Synthetic oligonucleotide
ccccaagaagagtttgttcc

SEQ ID NO: 620 - DNA, 20 bp, Artificial sequence
  Synthetic oligonucleotide
ctccccaagaagagtttgtt

SEQ ID NO: 621 - DNA, 20 bp, Artificial sequence
  Synthetic oligonucleotide
ctctccccaagaagagtttg

SEQ ID NO: 622 - DNA, 20 bp, Artificial sequence
  Synthetic oligonucleotide
gggccactctccccaagaag

SEQ ID NO: 623 - DNA, 20 bp, Artificial sequence
  Synthetic oligonucleotide
cagggccactctccccaaga

SEQ ID NO: 624 - DNA, 20 bp, Artificial sequence
  Synthetic oligonucleotide
tctgagctgtcagcttcacc

SEQ ID NO: 625 - DNA, 20 bp, Artificial sequence
  Synthetic oligonucleotide
gcctctgagctgtcagcttc

SEQ ID NO: 626 - DNA, 20 bp, Artificial sequence
  Synthetic oligonucleotide
tcctatgagtgaccctccac

SEQ ID NO: 627 - DNA, 20 bp, Artificial sequence
  Synthetic oligonucleotide
gtcctatgagtgaccctcca

SEQ ID NO: 628 - DNA, 20 bp, Artificial sequence
  Synthetic oligonucleotide
ggtgtcctatgagtgaccct

SEQ ID NO: 629 - DNA, 20 bp, Artificial sequence
  Synthetic oligonucleotide
tggtgtcctatgagtgaccc

SEQ ID NO: 630 - DNA, 20 bp, Artificial sequence
  Synthetic oligonucleotide
ccactggtgtcctatgagtg

SEQ ID NO: 631 - DNA, 20 bp, Artificial sequence
  Synthetic oligonucleotide
cccactggtgtcctatgagt

SEQ ID NO: 632 - DNA, 20 bp, Artificial sequence
  Synthetic oligonucleotide
gaagcccatcaaagcagtgg

SEQ ID NO: 633 - DNA, 20 bp, Artificial sequence
  Synthetic oligonucleotide
tatagatgcgccaaacatcc

SEQ ID NO: 634 - DNA, 20 bp, Artificial sequence
  Synthetic oligonucleotide
ctatagatgcgccaaacatc

SEQ ID NO: 635 - DNA, 20 bp, Artificial sequence
  Synthetic oligonucleotide
gccactatagatgcgccaaa

SEQ ID NO: 636 - DNA, 20 bp, Artificial sequence
  Synthetic oligonucleotide
atgccactatagatgcgcca

SEQ ID NO: 637 - DNA, 20 bp, Artificial sequence
  Synthetic oligonucleotide
taatgtctgacagatttaaa

SEQ ID NO: 638 - DNA, 20 bp, Artificial sequence
  Synthetic oligonucleotide
ttgtaatgtctgacagattt

SEQ ID NO: 639 - DNA, 20 bp, Artificial sequence
  Synthetic oligonucleotide
tgagaaaggtgtatcttttg

SEQ ID NO: 640 - DNA, 20 bp, Artificial sequence
  Synthetic oligonucleotide
ttgtgagaaaggtgtatctt

SEQ ID NO: 641 - DNA, 20 bp, Artificial sequence
  Synthetic oligonucleotide
tttgtgagaaaggtgtatct

SEQ ID NO: 642 - DNA, 20 bp, Artificial sequence
  Synthetic oligonucleotide
atttgtgagaaaggtgtatc

SEQ ID NO: 643 - DNA, 20 bp, Artificial sequence
  Synthetic oligonucleotide
ttatttgtgagaaaggtgta

SEQ ID NO: 644 - DNA, 20 bp, Artificial sequence
  Synthetic oligonucleotide
ttttatttgtgagaaaggtg

SEQ ID NO: 645 - DNA, 20 bp, Artificial sequence
  Synthetic oligonucleotide
cttttatttgtgagaaaggt

SEQ ID NO: 646 - DNA, 20 bp, Artificial sequence
  Synthetic oligonucleotide
ctcttttatttgtgagaaag

SEQ ID NO: 647 - DNA, 20 bp, Artificial sequence
  Synthetic oligonucleotide
ttggtgaataataatctctt

SEQ ID NO: 648 - DNA, 20 bp, Artificial sequence
  Synthetic oligonucleotide
tttggtgaataataatctct

SEQ ID NO: 649 - DNA, 20 bp, Artificial sequence
  Synthetic oligonucleotide
gttttggtgaataataatct

SEQ ID NO: 650 - DNA, 20 bp, Artificial sequence
  Synthetic oligonucleotide
tatagttttggtgaataata

SEQ ID NO: 651 - DNA, 20 bp, Artificial sequence
  Synthetic oligonucleotide
actttatagttttggtgaat

SEQ ID NO: 652 - DNA, 20 bp, Artificial sequence
  Synthetic oligonucleotide
cccttctgagactttatagt

SEQ ID NO: 653 - DNA, 20 bp, Artificial sequence
  Synthetic oligonucleotide
gattcccttctgagacttta

SEQ ID NO: 654 - DNA, 20 bp, Artificial sequence
  Synthetic oligonucleotide
catgattcccttctgagact

SEQ ID NO: 655 - DNA, 20 bp, Artificial sequence
  Synthetic oligonucleotide
tcatgattcccttctgagac

SEQ ID NO: 656 - DNA, 20 bp, Artificial sequence
  Synthetic oligonucleotide
tatcatgattcccttctgag

SEQ ID NO: 657 - DNA, 20 bp, Artificial sequence
  Synthetic oligonucleotide
atatcatgattcccttctga

SEQ ID NO: 658 - DNA, 20 bp, Artificial sequence
  Synthetic oligonucleotide
gcgatatcatgattcccttc

SEQ ID NO: 659 - DNA, 20 bp, Artificial sequence
  Synthetic oligonucleotide
ggcgatatcatgattccctt

SEQ ID NO: 660 - DNA, 20 bp, Artificial sequence
  Synthetic oligonucleotide
aaggcgatatcatgattccc

SEQ ID NO: 661 - DNA, 20 bp, Artificial sequence
  Synthetic oligonucleotide
tatcaaggcgatatcatgat

SEQ ID NO: 662 - DNA, 20 bp, Artificial sequence
  Synthetic oligonucleotide
gagttttatcaaggcgatat

SEQ ID NO: 663 - DNA, 20 bp, Artificial sequence
  Synthetic oligonucleotide
ctggagttttatcaaggcga

SEQ ID NO: 664 - DNA, 20 bp, Artificial sequence
  Synthetic oligonucleotide
gcctggagttttatcaaggc

SEQ ID NO: 665 - DNA, 20 bp, Artificial sequence
  Synthetic oligonucleotide
aggagcctggagttttatca

SEQ ID NO: 666 - DNA, 20 bp, Artificial sequence
  Synthetic oligonucleotide
attcaaaggagcctggagtt

SEQ ID NO: 667 - DNA, 20 bp, Artificial sequence
  Synthetic oligonucleotide
gtaattcaaaggagcctgga

SEQ ID NO: 668 - DNA, 20 bp, Artificial sequence
  Synthetic oligonucleotide
gtgtaattcaaaggagcctg

SEQ ID NO: 669 - DNA, 20 bp, Artificial sequence
  Synthetic oligonucleotide
cagtgtaattcaaaggagcc

SEQ ID NO: 670 - DNA, 20 bp, Artificial sequence
  Synthetic oligonucleotide
taggcatattggtttttgga

SEQ ID NO: 671 - DNA, 20 bp, Artificial sequence
  Synthetic oligonucleotide
ggtaggcatattggtttttg

SEQ ID NO: 672 - DNA, 20 bp, Artificial sequence
  Synthetic oligonucleotide
gaaggtaggcatattggttt

SEQ ID NO: 673 - DNA, 20 bp, Artificial sequence
  Synthetic oligonucleotide
cttgtgtcacctttggaagg

SEQ ID NO: 674 - DNA, 20 bp, Artificial sequence
  Synthetic oligonucleotide
gcttgtgtcacctttggaag

SEQ ID NO: 675 - DNA, 20 bp, Artificial sequence
  Synthetic oligonucleotide
gtgcttgtgtcacctttgga

SEQ ID NO: 676 - DNA, 20 bp, Artificial sequence
  Synthetic oligonucleotide
aaattgtgcttgtgtcacct

SEQ ID NO: 677 - DNA, 20 bp, Artificial sequence
  Synthetic oligonucleotide
gtataaattgtgcttgtgtc

SEQ ID NO: 678 - DNA, 20 bp, Artificial sequence
  Synthetic oligonucleotide
ggtataaattgtgcttgtgt

SEQ ID NO: 679 - DNA, 20 bp, Artificial sequence
  Synthetic oligonucleotide
tggtataaattgtgcttgtg

SEQ ID NO: 680 - DNA, 20 bp, Artificial sequence
  Synthetic oligonucleotide
gttggtataaattgtgcttg

SEQ ID NO: 681 - DNA, 20 bp, Artificial sequence
  Synthetic oligonucleotide
cagttggtataaattgtgct

SEQ ID NO: 682 - DNA, 20 bp, Artificial sequence
  Synthetic oligonucleotide
cccaacagttggtataaatt

SEQ ID NO: 683 - DNA, 20 bp, Artificial sequence
  Synthetic oligonucleotide
ttacccaacagttggtataa

SEQ ID NO: 684 - DNA, 20 bp, Artificial sequence
  Synthetic oligonucleotide
ggttacccaacagttggtat

SEQ ID NO: 685 - DNA, 20 bp, Artificial sequence
  Synthetic oligonucleotide
gaagccccatccggttaccc

SEQ ID NO: 686 - DNA, 20 bp, Artificial sequence
  Synthetic oligonucleotide
tcgagaagccccatccggtt

SEQ ID NO: 687 - DNA, 20 bp, Artificial sequence
  Synthetic oligonucleotide
ccttcgagaagccccatccg

SEQ ID NO: 688 - DNA, 20 bp, Artificial sequence
  Synthetic oligonucleotide
tttctccttcgagaagcccc

SEQ ID NO: 689 - DNA, 20 bp, Artificial sequence
  Synthetic oligonucleotide
cctttctccttcgagaagcc

SEQ ID NO: 690 - DNA, 20 bp, Artificial sequence
  Synthetic oligonucleotide
tcacctttctccttcgagaa

SEQ ID NO: 691 - DNA, 20 bp, Artificial sequence
  Synthetic oligonucleotide
ttcacctttctccttcgaga

SEQ ID NO: 692 - DNA, 20 bp, Artificial sequence
  Synthetic oligonucleotide
tttggatttcacctttctcc

SEQ ID NO: 693 - DNA, 20 bp, Artificial sequence
  Synthetic oligonucleotide
tgtagaatattttggatttc

SEQ ID NO: 694 - DNA, 20 bp, Artificial sequence
  Synthetic oligonucleotide
tttgttaccaaaggaatatt

SEQ ID NO: 695 - DNA, 20 bp, Artificial sequence
  Synthetic oligonucleotide
catttgttaccaaaggaata

SEQ ID NO: 696 - DNA, 20 bp, Artificial sequence
  Synthetic oligonucleotide
tcatttgttaccaaaggaat

SEQ ID NO: 697 - DNA, 20 bp, Artificial sequence
  Synthetic oligonucleotide
tcttcatttgttaccaaagg

SEQ ID NO: 698 - DNA, 20 bp, Artificial sequence
  Synthetic oligonucleotide
cattcttcatttgttaccaa

SEQ ID NO: 699 - DNA, 20 bp, Artificial sequence
  Synthetic oligonucleotide
cttgatatcttttctggcat

SEQ ID NO: 700 - DNA, 20 bp, Artificial sequence
  Synthetic oligonucleotide
taatcttgatatcttttctg

SEQ ID NO: 701 - DNA, 20 bp, Artificial sequence
  Synthetic oligonucleotide
tataatcttgatatcttttc

SEQ ID NO: 702 - DNA, 20 bp, Artificial sequence
  Synthetic oligonucleotide
ttctttatagccagcacaga

SEQ ID NO: 703 - DNA, 20 bp, Artificial sequence
  Synthetic oligonucleotide
ccttctttatagccagcaca

SEQ ID NO: 704 - DNA, 20 bp, Artificial sequence
  Synthetic oligonucleotide
ccccttctttatagccagca

SEQ ID NO: 705 - DNA, 20 bp, Artificial sequence
  Synthetic oligonucleotide
cccccttctttatagccagc

SEQ ID NO: 706 - DNA, 20 bp, Artificial sequence
  Synthetic oligonucleotide
tcccccttctttatagccag

SEQ ID NO: 707 - DNA, 20 bp, Artificial sequence
  Synthetic oligonucleotide
caagcatcttttcccccttc

SEQ ID NO: 708 - DNA, 20 bp, Artificial sequence
  Synthetic oligonucleotide
agggaccacctgaatctccc

SEQ ID NO: 709 - DNA, 20 bp, Artificial sequence
  Synthetic oligonucleotide
ctaagggaccacctgaatct

SEQ ID NO: 710 - DNA, 20 bp, Artificial sequence
  Synthetic oligonucleotide
actaagggaccacctgaatc

SEQ ID NO: 711 - DNA, 20 bp, Artificial sequence
  Synthetic oligonucleotide
caaactaagggaccacctga

SEQ ID NO: 712 - DNA, 20 bp, Artificial sequence
  Synthetic oligonucleotide
gcaaactaagggaccacctg

SEQ ID NO: 713 - DNA, 20 bp, Artificial sequence
  Synthetic oligonucleotide
tgcaaactaagggaccacct

SEQ ID NO: 714 - DNA, 20 bp, Artificial sequence
  Synthetic oligonucleotide
gtgtttgcaaactaagggac

SEQ ID NO: 715 - DNA, 20 bp, Artificial sequence
  Synthetic oligonucleotide
tgtgtttgcaaactaaggga

SEQ ID NO: 716 - DNA, 20 bp, Artificial sequence
  Synthetic oligonucleotide
ccctgcgggcacagccttca

SEQ ID NO: 717 - DNA, 20 bp, Artificial sequence
  Synthetic oligonucleotide
ttgctccctgcgggcacagc

SEQ ID NO: 718 - DNA, 20 bp, Artificial sequence
  Synthetic oligonucleotide
caccaggttgctccctgcgg

SEQ ID NO: 719 - DNA, 20 bp, Artificial sequence
  Synthetic oligonucleotide
acaccaggttgctccctgcg

SEQ ID NO: 720 - DNA, 20 bp, Artificial sequence
  Synthetic oligonucleotide
agacaccaggttgctccctg

SEQ ID NO: 721 - DNA, 20 bp, Artificial sequence
  Synthetic oligonucleotide
gtagacaccaggttgctccc

SEQ ID NO: 722 - DNA, 20 bp, Artificial sequence
  Synthetic oligonucleotide
ctcagcgactttggtgtaga

SEQ ID NO: 723 - DNA, 20 bp, Artificial sequence
  Synthetic oligonucleotide
gtactcagcgactttggtgt

SEQ ID NO: 724 - DNA, 20 bp, Artificial sequence
  Synthetic oligonucleotide
catgtactcagcgactttgg

SEQ ID NO: 725 - DNA, 20 bp, Artificial sequence
  Synthetic oligonucleotide
cagtccatgtactcagcgac

SEQ ID NO: 726 - DNA, 20 bp, Artificial sequence
  Synthetic oligonucleotide
tccagtccatgtactcagcg

SEQ ID NO: 727 - DNA, 20 bp, Artificial sequence
  Synthetic oligonucleotide
gcttttccatcactgctctg

SEQ ID NO: 728 - DNA, 20 bp, Artificial sequence
  Synthetic oligonucleotide
ctgagcttttccatcactgc

SEQ ID NO: 729 - DNA, 20 bp, Artificial sequence
  Synthetic oligonucleotide
tctgagcttttccatcactg

SEQ ID NO: 730 - DNA, 20 bp, Artificial sequence
  Synthetic oligonucleotide
gcatctgagcttttccatca

SEQ ID NO: 731 - DNA, 20 bp, Artificial sequence
  Synthetic oligonucleotide
actgcatctgagcttttcca

SEQ ID NO: 732 - DNA, 20 bp, Artificial sequence
  Synthetic oligonucleotide
tggtgactgcatctgagctt

SEQ ID NO: 733 - DNA, 20 bp, Artificial sequence
  Synthetic oligonucleotide
gctggtgactgcatctgagc

SEQ ID NO: 734 - DNA, 20 bp, Artificial sequence
  Synthetic oligonucleotide
atgctggtgactgcatctga

SEQ ID NO: 735 - DNA, 20 bp, Artificial sequence
  Synthetic oligonucleotide
tcatgctggtgactgcatct

SEQ ID NO: 736 - DNA, 20 bp, Artificial sequence
  Synthetic oligonucleotide
cttctcatgctggtgactgc

SEQ ID NO: 737 - DNA, 20 bp, Artificial sequence
  Synthetic oligonucleotide
actgcttctcatgctggtga

SEQ ID NO: 738 - DNA, 20 bp, Artificial sequence
  Synthetic oligonucleotide
ggactgcttctcatgctggt

SEQ ID NO: 739 - DNA, 20 bp, Artificial sequence
  Synthetic oligonucleotide
ctggactgcttctcatgctg

SEQ ID NO: 740 - DNA, 20 bp, Artificial sequence
  Synthetic oligonucleotide
ctctggactgcttctcatgc

SEQ ID NO: 741 - DNA, 20 bp, Artificial sequence
  Synthetic oligonucleotide
agactctggactgcttctca

SEQ ID NO: 742 - DNA, 20 bp, Artificial sequence
  Synthetic oligonucleotide
cctagactctggactgcttc

SEQ ID NO: 743 - DNA, 20 bp, Artificial sequence
  Synthetic oligonucleotide
tgcctagactctggactgct

SEQ ID NO: 744 - DNA, 20 bp, Artificial sequence
  Synthetic oligonucleotide
attgcctagactctggactg

SEQ ID NO: 745 - DNA, 20 bp, Artificial sequence
  Synthetic oligonucleotide
aaaaattgcctagactctgg

SEQ ID NO: 746 - DNA, 20 bp, Artificial sequence
  Synthetic oligonucleotide
ggttgtaaaaattgcctaga

SEQ ID NO: 747 - DNA, 20 bp, Artificial sequence
  Synthetic oligonucleotide
tcaggttgtaaaaattgcct

SEQ ID NO: 748 - DNA, 20 bp, Artificial sequence
  Synthetic oligonucleotide
ctcaggttgtaaaaattgcc

SEQ ID NO: 749 - DNA, 20 bp, Artificial sequence
  Synthetic oligonucleotide
actcaggttgtaaaaattgc

SEQ ID NO: 750 - DNA, 20 bp, Artificial sequence
  Synthetic oligonucleotide
gaactcaggttgtaaaaatt

SEQ ID NO: 751 - DNA, 20 bp, Artificial sequence
  Synthetic oligonucleotide
acttgaactcaggttgtaaa

SEQ ID NO: 752 - DNA, 20 bp, Artificial sequence
  Synthetic oligonucleotide
gacttgaactcaggttgtaa

SEQ ID NO: 753 - DNA, 20 bp, Artificial sequence
  Synthetic oligonucleotide
gaatttgacttgaactcagg

SEQ ID NO: 754 - DNA, 20 bp, Artificial sequence
  Synthetic oligonucleotide
ctcagaatttgacttgaact

SEQ ID NO: 755 - DNA, 20 bp, Artificial sequence
  Synthetic oligonucleotide
aggctcagaatttgacttga

SEQ ID NO: 756 - DNA, 20 bp, Artificial sequence
  Synthetic oligonucleotide
caggctcagaatttgacttg

SEQ ID NO: 757 - DNA, 20 bp, Artificial sequence
  Synthetic oligonucleotide
ccaggctcagaatttgactt

SEQ ID NO: 758 - DNA, 20 bp, Artificial sequence
  Synthetic oligonucleotide
ccccaggctcagaatttgac

SEQ ID NO: 759 - DNA, 20 bp, Artificial sequence
  Synthetic oligonucleotide
ccccccaggctcagaatttg

SEQ ID NO: 760 - DNA, 20 bp, Artificial sequence
  Synthetic oligonucleotide
gaccccccaggctcagaatt

SEQ ID NO: 761 - DNA, 20 bp, Artificial sequence
  Synthetic oligonucleotide
atgaggaccccccaggctca

SEQ ID NO: 762 - DNA, 20 bp, Artificial sequence
  Synthetic oligonucleotide
gatgaggaccccccaggctc

SEQ ID NO: 763 - DNA, 20 bp, Artificial sequence
  Synthetic oligonucleotide
gcagatgaggaccccccagg

SEQ ID NO: 764 - DNA, 20 bp, Artificial sequence
  Synthetic oligonucleotide
tgcagatgaggaccccccag

SEQ ID NO: 765 - DNA, 20 bp, Artificial sequence
  Synthetic oligonucleotide
tttgcagatgaggacccccc

SEQ ID NO: 766 - DNA, 20 bp, Artificial sequence
  Synthetic oligonucleotide
ctccatgctttgcagatgag

SEQ ID NO: 767 - DNA, 20 bp, Artificial sequence
  Synthetic oligonucleotide
gccactctccatgctttgca

SEQ ID NO: 768 - DNA, 20 bp, Artificial sequence
  Synthetic oligonucleotide
agatgccactctccatgctt

SEQ ID NO: 769 - DNA, 20 bp, Artificial sequence
  Synthetic oligonucleotide
gaagatgccactctccatgc

SEQ ID NO: 770 - DNA, 20 bp, Artificial sequence
  Synthetic oligonucleotide
agaagatgccactctccatg

SEQ ID NO: 771 - DNA, 20 bp, Artificial sequence
  Synthetic oligonucleotide
caaagaagatgccactctcc

SEQ ID NO: 772 - DNA, 20 bp, Artificial sequence
  Synthetic oligonucleotide
gatgcaaagaagatgccact

SEQ ID NO: 773 - DNA, 20 bp, Artificial sequence
  Synthetic oligonucleotide
ggatgcaaagaagatgccac

SEQ ID NO: 774 - DNA, 20 bp, Artificial sequence
  Synthetic oligonucleotide
taggatgcaaagaagatgcc

SEQ ID NO: 775 - DNA, 20 bp, Artificial sequence
  Synthetic oligonucleotide
tccttaggatgcaaagaaga

SEQ ID NO: 776 - DNA, 20 bp, Artificial sequence
  Synthetic oligonucleotide
cgtccttaggatgcaaagaa

SEQ ID NO: 777 - DNA, 20 bp, Artificial sequence
  Synthetic oligonucleotide
attgtcctcagcagctctga

SEQ ID NO: 778 - DNA, 20 bp, Artificial sequence
  Synthetic oligonucleotide
ccagacattgtcctcagcag

SEQ ID NO: 779 - DNA, 20 bp, Artificial sequence
  Synthetic oligonucleotide
agccagacattgtcctcagc

SEQ ID NO: 780 - DNA, 20 bp, Artificial sequence
  Synthetic oligonucleotide
tcagccagacattgtcctca

SEQ ID NO: 781 - DNA, 20 bp, Artificial sequence
  Synthetic oligonucleotide
cttcagccagacattgtcct

SEQ ID NO: 782 - DNA, 20 bp, Artificial sequence
  Synthetic oligonucleotide
agcgggcttcagccagacat

SEQ ID NO: 783 - DNA, 20 bp, Artificial sequence
  Synthetic oligonucleotide
gaaagcgggcttcagccaga

SEQ ID NO: 784 - DNA, 20 bp, Artificial sequence
  Synthetic oligonucleotide
ctgaaagcgggcttcagcca

SEQ ID NO: 785 - DNA, 20 bp, Artificial sequence
  Synthetic oligonucleotide
cgtgctgaaagcgggcttca

SEQ ID NO: 786 - DNA, 20 bp, Artificial sequence
  Synthetic oligonucleotide
gtcagcccctggttacggcg

SEQ ID NO: 787 - DNA, 20 bp, Artificial sequence
  Synthetic oligonucleotide
ttgtcagcccctggttacgg

SEQ ID NO: 788 - DNA, 20 bp, Artificial sequence
  Synthetic oligonucleotide
cattgtcagcccctggttac

SEQ ID NO: 789 - DNA, 20 bp, Artificial sequence
  Synthetic oligonucleotide
gcattgtcagcccctggtta

SEQ ID NO: 790 - DNA, 20 bp, Artificial sequence
  Synthetic oligonucleotide
cctcgcattgtcagcccctg

SEQ ID NO: 791 - DNA, 20 bp, Artificial sequence
  Synthetic oligonucleotide
gacctcgcattgtcagcccc

SEQ ID NO: 792 - DNA, 20 bp, Artificial sequence
  Synthetic oligonucleotide
gcgacctcgcattgtcagcc

SEQ ID NO: 793 - DNA, 20 bp, Artificial sequence
  Synthetic oligonucleotide
ctcagttgcgacctcgcatt

SEQ ID NO: 794 - DNA, 20 bp, Artificial sequence
  Synthetic oligonucleotide
tctcagttgcgacctcgcat

SEQ ID NO: 795 - DNA, 20 bp, Artificial sequence
  Synthetic oligonucleotide
gtcatggagatctcagttgc

SEQ ID NO: 796 - DNA, 20 bp, Artificial sequence
  Synthetic oligonucleotide
cacagtcatggagatctcag

SEQ ID NO: 797 - DNA, 20 bp, Artificial sequence
  Synthetic oligonucleotide
ccatgaacatcctatccgtg

SEQ ID NO: 798 - DNA, 20 bp, Artificial sequence
  Synthetic oligonucleotide
tgtcctgtcaacatattcca

SEQ ID NO: 799 - DNA, 20 bp, Artificial sequence
  Synthetic oligonucleotide
gggtttctgccaacagtttc

SEQ ID NO: 800 - DNA, 20 bp, Artificial sequence
  Synthetic oligonucleotide
gactttgggtttctgccaac

SEQ ID NO: 801 - DNA, 20 bp, Artificial sequence
  Synthetic oligonucleotide
atattgactttgggtttctg

SEQ ID NO: 802 - DNA, 20 bp, Artificial sequence
  Synthetic oligonucleotide
ggcttcaatattgactttgg

SEQ ID NO: 803 - DNA, 20 bp, Artificial sequence
  Synthetic oligonucleotide
ctgcaggcaatattttgctt

SEQ ID NO: 804 - DNA, 20 bp, Artificial sequence
  Synthetic oligonucleotide
atgtggcactgcaggcaata

SEQ ID NO: 805 - DNA, 20 bp, Artificial sequence
  Synthetic oligonucleotide
ttctaatgtggcactgcagg

SEQ ID NO: 806 - DNA, 20 bp, Artificial sequence
  Synthetic oligonucleotide
tcaagctgttctaatgtggc

SEQ ID NO: 807 - DNA, 20 bp, Artificial sequence
  Synthetic oligonucleotide
acggtcttcaagctgttcta

SEQ ID NO: 808 - DNA, 20 bp, Artificial sequence
  Synthetic oligonucleotide
ggtcaatctgactagtgaat

SEQ ID NO: 809 - DNA, 20 bp, Artificial sequence
  Synthetic oligonucleotide
tctctggtcaatctgactag

SEQ ID NO: 810 - DNA, 20 bp, Artificial sequence
  Synthetic oligonucleotide
gcccaccaacaatctctggt

SEQ ID NO: 811 - DNA, 20 bp, Artificial sequence
  Synthetic oligonucleotide
gaccccaacagacagcccac

SEQ ID NO: 812 - DNA, 20 bp, Artificial sequence
  Synthetic oligonucleotide
ccagaatcatgccttgtggg

SEQ ID NO: 813 - DNA, 20 bp, Artificial sequence
  Synthetic oligonucleotide
gtcaccatagacccagaatc

SEQ ID NO: 814 - DNA, 20 bp, Artificial sequence
  Synthetic oligonucleotide
gtggccctcttaagtcacca

SEQ ID NO: 815 - DNA, 20 bp, Artificial sequence
  Synthetic oligonucleotide
ctcattgttgtgtggccctc

SEQ ID NO: 816 - DNA, 20 bp, Artificial sequence
  Synthetic oligonucleotide
gtagccatacatctgaggaa

SEQ ID NO: 817 - DNA, 20 bp, Artificial sequence
  Synthetic oligonucleotide
atgtttattgtagccataca

SEQ ID NO: 818 - DNA, 20 bp, Artificial sequence
  Synthetic oligonucleotide
ctcgcctttgtgactcgatt

SEQ ID NO: 819 - DNA, 20 bp, Artificial sequence
  Synthetic oligonucleotide
catactcgcctttgtgactc

SEQ ID NO: 820 - DNA, 20 bp, Artificial sequence
  Synthetic oligonucleotide
gcatactcgcctttgtgact

SEQ ID NO: 821 - DNA, 20 bp, Artificial sequence
  Synthetic oligonucleotide
tgcatactcgcctttgtgac

SEQ ID NO: 822 - DNA, 20 bp, Artificial sequence
  Synthetic oligonucleotide
ttcacaacacacagtcatgg

SEQ ID NO: 823 - DNA, 20 bp, Artificial sequence
  Synthetic oligonucleotide
ttttttgatctttcaccatt

SEQ ID NO: 824 - DNA, 20 bp, Artificial sequence
  Synthetic oligonucleotide
atgcatactcgcctttgtga

SEQ ID NO: 825 - DNA, 20 bp, Artificial sequence
  Synthetic oligonucleotide
catgcatactcgcctttgtg

SEQ ID NO: 826 - DNA, 20 bp, Artificial sequence
  Synthetic oligonucleotide
ccatgcatactcgcctttgt

SEQ ID NO: 827 - DNA, 20 bp, Artificial sequence
  Synthetic oligonucleotide
acacacagtcatggagatct

SEQ ID NO: 828 - DNA, 20 bp, Artificial sequence
  Synthetic oligonucleotide
acaacacacagtcatggaga

SEQ ID NO: 829 - DNA, 20 bp, Artificial sequence
  Synthetic oligonucleotide
ttatttcacaacacacagtc

SEQ ID NO: 830 - DNA, 20 bp, Artificial sequence
  Synthetic oligonucleotide
tccatgcatactcgcctttg

SEQ ID NO: 831 - DNA, 20 bp, Artificial sequence
  Synthetic oligonucleotide
ttccatgcatactcgccttt

SEQ ID NO: 832 - DNA, 20 bp, Artificial sequence
  Synthetic oligonucleotide
tttccatgcatactcgcctt

SEQ ID NO: 833 - DNA, 20 bp, Artificial sequence
  Synthetic oligonucleotide
gattttccatgcatactcgc

SEQ ID NO: 834 - DNA, 20 bp, Artificial sequence
  Synthetic oligonucleotide
gtgatgcgattttccatgca

SEQ ID NO: 835 - DNA, 20 bp, Artificial sequence
  Synthetic oligonucleotide
gcagcaagtgctccccatgc

SEQ ID NO: 836 - DNA, 20 bp, Artificial sequence
  Synthetic oligonucleotide
gtgatgaaagtacagcagca

SEQ ID NO: 837 - DNA, 20 bp, Artificial sequence
  Synthetic oligonucleotide
tcctatccgtgttcagctgt

SEQ ID NO: 838 - DNA, 20 bp, Artificial sequence
  Synthetic oligonucleotide
tactctctacatactcagga

SEQ ID NO: 839 - DNA, 20 bp, Artificial sequence
  Synthetic oligonucleotide
tgagacctccagactactgt

SEQ ID NO: 840 - DNA, 20 bp, Artificial sequence
  Synthetic oligonucleotide
ctctgctggttttagaccac

SEQ ID NO: 841 - DNA, 20 bp, Artificial sequence
  Synthetic oligonucleotide
gggacaatctccacccccga

SEQ ID NO: 842 - DNA, 20 bp, Artificial sequence
  Synthetic oligonucleotide
tgcagagtgtcatctgcgaa

SEQ ID NO: 843 - DNA, 20 bp, Artificial sequence
  Synthetic oligonucleotide
tggttccctagcggtccaga

SEQ ID NO: 844 - DNA, 20 bp, Artificial sequence
  Synthetic oligonucleotide
cccctgtagttggctgtggt

SEQ ID NO: 845 - DNA, 20 bp, Artificial sequence
  Synthetic oligonucleotide
gcaagtcaaagagtgtccac

SEQ ID NO: 846 - DNA, 20 bp, Artificial sequence
  Synthetic oligonucleotide
gaagcctgttagagttggcc

SEQ ID NO: 847 - DNA, 20 bp, Artificial sequence
  Synthetic oligonucleotide
cccccatgtccatggacttt

SEQ ID NO: 848 - DNA, 20 bp, Artificial sequence
  Synthetic oligonucleotide
ctgccaacagtttcaacttt

SEQ ID NO: 849 - DNA, 20 bp, Artificial sequence
  Synthetic oligonucleotide
ttttgcttggcttcaatatt

SEQ ID NO: 850 - DNA, 20 bp, Artificial sequence
  Synthetic oligonucleotide
atctgactagtgaatggctt

SEQ ID NO: 851 - DNA, 20 bp, Artificial sequence
  Synthetic oligonucleotide
agacagcccaccaacaatct

SEQ ID NO: 852 - DNA, 20 bp, Artificial sequence
  Synthetic oligonucleotide
tgcatagaccccaacagaca

SEQ ID NO: 853 - DNA, 20 bp, Artificial sequence
  Synthetic oligonucleotide
cctgtgcatagaccccaaca

SEQ ID NO: 854 - DNA, 20 bp, Artificial sequence
  Synthetic oligonucleotide
ccagcagaaatcctgtgcat

SEQ ID NO: 855 - DNA, 20 bp, Artificial sequence
  Synthetic oligonucleotide
agaactccagcagaaatcct

SEQ ID NO: 856 - DNA, 20 bp, Artificial sequence
  Synthetic oligonucleotide
ttgtgtggccctcttaagtc

SEQ ID NO: 857 - DNA, 20 bp, Artificial sequence
  Synthetic oligonucleotide
tatagatgtttattgtagcc

SEQ ID NO: 858 - DNA, 20 bp, Artificial sequence
  Synthetic oligonucleotide
atactcgcctttgtgactcg

SEQ ID NO: 859 - DNA, 20 bp, Artificial sequence
  Synthetic oligonucleotide
ttttccatgcatactcgcct

SEQ ID NO: 860 - DNA, 20 bp, Artificial sequence
  Synthetic oligonucleotide
tcgcctttgtgatgcgattt

SEQ ID NO: 861 - DNA, 20 bp, Artificial sequence
  Synthetic oligonucleotide
atactcgcctttgtgatgcg

SEQ ID NO: 862 - DNA, 20 bp, Artificial sequence
  Synthetic oligonucleotide
catactcgcctttgtgatgc

SEQ ID NO: 863 - DNA, 20 bp, Artificial sequence
  Synthetic oligonucleotide
gcatactcgcctttgtgatg

SEQ ID NO: 864 - DNA, 20 bp, Artificial sequence
  Synthetic oligonucleotide
tgcatactcgcctttgtgat

SEQ ID NO: 865 - DNA, 20 bp, Artificial sequence
  Synthetic oligonucleotide
cccatgcatactcgcctttg

SEQ ID NO: 866 - DNA, 20 bp, Artificial sequence
  Synthetic oligonucleotide
ccccatgcatactcgccttt

SEQ ID NO: 867 - DNA, 20 bp, Artificial sequence
  Synthetic oligonucleotide
tccccatgcatactcgcctt

SEQ ID NO: 868 - DNA, 20 bp, Artificial sequence
  Synthetic oligonucleotide
ctccccatgcatactcgcct

SEQ ID NO: 869 - DNA, 20 bp, Artificial sequence
  Synthetic oligonucleotide
tgctccccatgcatactcgc

SEQ ID NO: 870 - DNA, 20 bp, Artificial sequence
  Synthetic oligonucleotide
gctctgattgggtcaccaca

SEQ ID NO: 871 - DNA, 20 bp, Artificial sequence
  Synthetic oligonucleotide
tgtctccttccacttgctcc

SEQ ID NO: 872 - DNA, 20 bp, Artificial sequence
  Synthetic oligonucleotide
gccattttatccctgagatt

SEQ ID NO: 873 - DNA, 20 bp, Artificial sequence
  Synthetic oligonucleotide
ctgtgctgtattttggagcc

SEQ ID NO: 874 - DNA, 20 bp, Artificial sequence
  Synthetic oligonucleotide
ggatttggccctgagcccca

SEQ ID NO: 875 - DNA, 20 bp, Artificial sequence
  Synthetic oligonucleotide
caacctgtccattccctggg

SEQ ID NO: 876 - DNA, 20 bp, Artificial sequence
  Synthetic oligonucleotide
attcggtgtctttactggct

SEQ ID NO: 877 - DNA, 20 bp, Artificial sequence
  Synthetic oligonucleotide
tcctgttgcctgacatgcta

SEQ ID NO: 878 - DNA, 20 bp, Artificial sequence
  Synthetic oligonucleotide
ctcccactgactgactactc

SEQ ID NO: 879 - DNA, 20 bp, Artificial sequence
  Synthetic oligonucleotide
gctggtccttgaaccccgtg

SEQ ID NO: 880 - DNA, 20 bp, Artificial sequence
  Synthetic oligonucleotide
ctggctcactataggcccca

SEQ ID NO: 881 - DNA, 20 bp, Artificial sequence
  Synthetic oligonucleotide
ataagcatctctctgaccta

SEQ ID NO: 882 - DNA, 20 bp, Artificial sequence
  Synthetic oligonucleotide
gcttccccaatacttgctgg

SEQ ID NO: 883 - DNA, 20 bp, Artificial sequence
  Synthetic oligonucleotide
gtgtccagaatactgcccca

SEQ ID NO: 884 - DNA, 20 bp, Artificial sequence
  Synthetic oligonucleotide
gtggacgactgccctgtgcc

SEQ ID NO: 885 - DNA, 20 bp, Artificial sequence
  Synthetic oligonucleotide
tctctagcatcctagtcctc

SEQ ID NO: 886 - DNA, 20 bp, Artificial sequence
  Synthetic oligonucleotide
atactggctaagtcaggccc

SEQ ID NO: 887 - DNA, 20 bp, Artificial sequence
  Synthetic oligonucleotide
ggcagggaggtggattattc

SEQ ID NO: 888 - DNA, 20 bp, Artificial sequence
  Synthetic oligonucleotide
gcttctctatctcccagtgt

SEQ ID NO: 889 - DNA, 20 bp, Artificial sequence
  Synthetic oligonucleotide
gatgcatgcagcaatacagg

SEQ ID NO: 890 - DNA, 20 bp, Artificial sequence
  Synthetic oligonucleotide
gtctcgatggcaagctgtac

SEQ ID NO: 891 - DNA, 20 bp, Artificial sequence
  Synthetic oligonucleotide
gtactcaccggtactctgcc

SEQ ID NO: 892 - DNA, 20 bp, Artificial sequence
  Synthetic oligonucleotide
atgaagggcgaggcgcagtg

SEQ ID NO: 893 - DNA, 20 bp, Artificial sequence
  Synthetic oligonucleotide
ccccatacatctatgcaaat

SEQ ID NO: 894 - DNA, 20 bp, Artificial sequence
  Synthetic oligonucleotide
acatgactccagtgatggat

SEQ ID NO: 895 - DNA, 20 bp, Artificial sequence
  Synthetic oligonucleotide
aaaatgacaccaaaattcgc

SEQ ID NO: 896 - DNA, 20 bp, Artificial sequence
  Synthetic oligonucleotide
tggacatccttcccctcgca

SEQ ID NO: 897 - DNA, 20 bp, Artificial sequence
  Synthetic oligonucleotide
gctctgagccttccgcctct

SEQ ID NO: 898 - DNA, 20 bp, Artificial sequence
  Synthetic oligonucleotide
actagtttcctataactgct

SEQ ID NO: 899 - DNA, 20 bp, Artificial sequence
  Synthetic oligonucleotide
tactagtttcctataactgc

SEQ ID NO: 900 - DNA, 20 bp, Artificial sequence
  Synthetic oligonucleotide
gtactagtttcctataactg

SEQ ID NO: 901 - DNA, 20 bp, Artificial sequence
  Synthetic oligonucleotide
gtatcactgtactagtttcc

SEQ ID NO: 902 - DNA, 20 bp, Artificial sequence
  Synthetic oligonucleotide
agtatcactgtactagtttc

SEQ ID NO: 903 - DNA, 20 bp, Artificial sequence
  Synthetic oligonucleotide
cagtatcactgtactagttt

SEQ ID NO: 904 - DNA, 20 bp, Artificial sequence
  Synthetic oligonucleotide
acagtatcactgtactagtt

SEQ ID NO: 905 - DNA, 20 bp, Artificial sequence
  Synthetic oligonucleotide
aacagtatcactgtactagt

SEQ ID NO: 906 - DNA, 20 bp, Artificial sequence
  Synthetic oligonucleotide
taacagtatcactgtactag

SEQ ID NO: 907 - DNA, 20 bp, Artificial sequence
  Synthetic oligonucleotide
tctaacagtatcactgtact

SEQ ID NO: 908 - DNA, 20 bp, Artificial sequence
  Synthetic oligonucleotide
ctctaacagtatcactgtac

SEQ ID NO: 909 - DNA, 20 bp, Artificial sequence
  Synthetic oligonucleotide
actctaacagtatcactgta

SEQ ID NO: 910 - DNA, 20 bp, Artificial sequence
  Synthetic oligonucleotide
aactctaacagtatcactgt

SEQ ID NO: 911 - DNA, 20 bp, Artificial sequence
  Synthetic oligonucleotide
taactctaacagtatcactg

SEQ ID NO: 912 - DNA, 20 bp, Artificial sequence
  Synthetic oligonucleotide
ataactctaacagtatcact

SEQ ID NO: 913 - DNA, 20 bp, Artificial sequence
  Synthetic oligonucleotide
tataactctaacagtatcac

SEQ ID NO: 914 - DNA, 20 bp, Artificial sequence
  Synthetic oligonucleotide
ctataactctaacagtatca

SEQ ID NO: 915 - DNA, 20 bp, Artificial sequence
  Synthetic oligonucleotide
cctataactctaacagtatc

SEQ ID NO: 916 - DNA, 20 bp, Artificial sequence
  Synthetic oligonucleotide
ctgtcctataactctaacag

SEQ ID NO: 917 - DNA, 20 bp, Artificial sequence
  Synthetic oligonucleotide
cactgtcctataactctaac

SEQ ID NO: 918 - DNA, 20 bp, Artificial sequence
  Synthetic oligonucleotide
tcactgtcctataactctaa

SEQ ID NO: 919 - DNA, 20 bp, Artificial sequence
  Synthetic oligonucleotide
tatcactgtcctataactct

SEQ ID NO: 920 - DNA, 20 bp, Artificial sequence
  Synthetic oligonucleotide
gtcctatatcactgtcctat

SEQ ID NO: 921 - DNA, 20 bp, Artificial sequence
  Synthetic oligonucleotide
tgtcctatatcactgtccta

SEQ ID NO: 922 - DNA, 20 bp, Artificial sequence
  Synthetic oligonucleotide
ctgtcctatatcactgtcct

SEQ ID NO: 923 - DNA, 20 bp, Artificial sequence
  Synthetic oligonucleotide
actgtcctatatcactgtcc

SEQ ID NO: 924 - DNA, 20 bp, Artificial sequence
  Synthetic oligonucleotide
tcactgtcctatatcactgt

SEQ ID NO: 925 - DNA, 20 bp, Artificial sequence
  Synthetic oligonucleotide
cccccagttcccatgcaagg

SEQ ID NO: 926 - DNA, 20 bp, Artificial sequence
  Synthetic oligonucleotide
gagcacagatctcttcaagt

SEQ ID NO: 927 - DNA, 20 bp, Artificial sequence
  Synthetic oligonucleotide
gacggtcacccagccctgac

SEQ ID NO: 928 - DNA, 20 bp, Artificial sequence
  Synthetic oligonucleotide
aagggaaattagaggcaggc

SEQ ID NO: 929 - DNA, 20 bp, Artificial sequence
  Synthetic oligonucleotide
ctttcttgagacaatccctt

SEQ ID NO: 930 - DNA, 20 bp, Artificial sequence
  Synthetic oligonucleotide
gtgggatcagagaatgacta

SEQ ID NO: 931 - DNA, 20 bp, Artificial sequence
  Synthetic oligonucleotide
ccctctgtcttagatgtcca

SEQ ID NO: 932 - DNA, 20 bp, Artificial sequence
  Synthetic oligonucleotide
cttatcagtcccagtcatgt

SEQ ID NO: 933 - DNA, 20 bp, Artificial sequence
  Synthetic oligonucleotide
aagagttgggatgcgactct

SEQ ID NO: 934 - DNA, 20 bp, Artificial sequence
  Synthetic oligonucleotide
tccactcctaagaagtatgg

SEQ ID NO: 935 - DNA, 20 bp, Artificial sequence
  Synthetic oligonucleotide
gcacccttttcattgagatt

SEQ ID NO: 936 - DNA, 20 bp, Artificial sequence
  Synthetic oligonucleotide
actaccatttgggttggtag

SEQ ID NO: 937 - DNA, 20 bp, Artificial sequence
  Synthetic oligonucleotide
aagccctgtttggtttttag

SEQ ID NO: 938 - DNA, 20 bp, Artificial sequence
  Synthetic oligonucleotide
aaatgacaccaaaattgagt

SEQ ID NO: 939 - DNA, 20 bp, Artificial sequence
  Synthetic oligonucleotide
aaatgacaccaaaattcgct

SEQ ID NO: 940 - DNA, 20 bp, Artificial sequence
  Synthetic oligonucleotide
taagcaaggcctatgtgtgg

SEQ ID NO: 941 - DNA, 20 bp, Artificial sequence
  Synthetic oligonucleotide
acacgcacaggtcccagggc

SEQ ID NO: 942 - DNA, 20 bp, Artificial sequence
  Synthetic oligonucleotide
gggaaactctttcctcgccc

SEQ ID NO: 943 - DNA, 20 bp, Artificial sequence
  Synthetic oligonucleotide
ctagtttcctataactgctg

SEQ ID NO: 944 - DNA, 20 bp, Artificial sequence
  Synthetic oligonucleotide
ctaacagtatcactgtacta

SEQ ID NO: 945 - DNA, 20 bp, Artificial sequence
  Synthetic oligonucleotide
gtcctataactctaacagta

SEQ ID NO: 946 - DNA, 20 bp, Artificial sequence
  Synthetic oligonucleotide
tgtcctataactctaacagt

SEQ ID NO: 947 - DNA, 20 bp, Artificial sequence
  Synthetic oligonucleotide
atcactgtcctataactcta

SEQ ID NO: 948 - DNA, 20 bp, Artificial sequence
  Synthetic oligonucleotide
atatcactgtcctataactc

SEQ ID NO: 949 - DNA, 20 bp, Artificial sequence
  Synthetic oligonucleotide
tatatcactgtcctataact

SEQ ID NO: 950 - DNA, 20 bp, Artificial sequence
  Synthetic oligonucleotide
cactgtcctatatcactgtc

SEQ ID NO: 951 - DNA, 20 bp, Artificial sequence
  Synthetic oligonucleotide
atcactgtcctatatcactg

SEQ ID NO: 952 - DNA, 20 bp, Artificial sequence
  Synthetic oligonucleotide
tatcactgtcctatatcact

SEQ ID NO: 953 - DNA, 20 bp, Artificial sequence
  Synthetic oligonucleotide
agtatcactgtcctatatca

SEQ ID NO: 954 - DNA, 20 bp, Artificial sequence
  Synthetic oligonucleotide
cagtatcactgtcctatatc

SEQ ID NO: 955 - DNA, 20 bp, Artificial sequence
  Synthetic oligonucleotide
acagtatcactgtcctatat

SEQ ID NO: 956 - DNA, 20 bp, Artificial sequence
  Synthetic oligonucleotide
taacagtatcactgtcctat

SEQ ID NO: 957 - DNA, 20 bp, Artificial sequence
  Synthetic oligonucleotide
ataacagtatcactgtccta

SEQ ID NO: 958 - DNA, 20 bp, Artificial sequence
  Synthetic oligonucleotide
aactataacagtatcactgt

SEQ ID NO: 959 - DNA, 20 bp, Artificial sequence
  Synthetic oligonucleotide
tataactataacagtatcac

SEQ ID NO: 960 - DNA, 20 bp, Artificial sequence
  Synthetic oligonucleotide
ctataactataacagtatca

SEQ ID NO: 961 - DNA, 20 bp, Artificial sequence
  Synthetic oligonucleotide
tttcctataactataacagt

SEQ ID NO: 962 - DNA, 20 bp, Artificial sequence
  Synthetic oligonucleotide
ctagtttcctataactataa

SEQ ID NO: 963 - DNA, 20 bp, Artificial sequence
  Synthetic oligonucleotide
taacaatatcactgtcctat

SEQ ID NO: 964 - DNA, 20 bp, Artificial sequence
  Synthetic oligonucleotide
aactataacaatatcactgt

SEQ ID NO: 965 - DNA, 20 bp, Artificial sequence
  Synthetic oligonucleotide
taactataacaatatcactg

SEQ ID NO: 966 - DNA, 20 bp, Artificial sequence
  Synthetic oligonucleotide
ataactataacaatatcact

SEQ ID NO: 967 - DNA, 20 bp, Artificial sequence
  Synthetic oligonucleotide
tataactataacaatatcac

SEQ ID NO: 968 - DNA, 20 bp, Artificial sequence
  Synthetic oligonucleotide
gtttcctataactataacaa

SEQ ID NO: 969 - DNA, 20 bp, Artificial sequence
  Synthetic oligonucleotide
acctataactctaacagtat

SEQ ID NO: 970 - DNA, 20 bp, Artificial sequence
  Synthetic oligonucleotide
tacctataactctaacagta

SEQ ID NO: 971 - DNA, 20 bp, Artificial sequence
  Synthetic oligonucleotide
tgtacctataactctaacag

SEQ ID NO: 972 - DNA, 20 bp, Artificial sequence
  Synthetic oligonucleotide
ctgtacctataactctaaca

SEQ ID NO: 973 - DNA, 20 bp, Artificial sequence
  Synthetic oligonucleotide
actgtacctataactctaac

SEQ ID NO: 974 - DNA, 20 bp, Artificial sequence
  Synthetic oligonucleotide
cactgtacctataactctaa

SEQ ID NO: 975 - DNA, 20 bp, Artificial sequence
  Synthetic oligonucleotide
caatatcactgtacctataa

SEQ ID NO: 976 - DNA, 20 bp, Artificial sequence
  Synthetic oligonucleotide
ataacaatatcactgtacct

SEQ ID NO: 977 - DNA, 20 bp, Artificial sequence
  Synthetic oligonucleotide
actataacaatatcactgta

SEQ ID NO: 978 - DNA, 20 bp, Artificial sequence
  Synthetic oligonucleotide
gtcctatatcactgtacctg

SEQ ID NO: 979 - DNA, 20 bp, Artificial sequence
  Synthetic oligonucleotide
cactgtcctatatcactgta

SEQ ID NO: 980 - DNA, 20 bp, Artificial sequence
  Synthetic oligonucleotide
cctataacagtatcactgtc

SEQ ID NO: 981 - DNA, 20 bp, Artificial sequence
  Synthetic oligonucleotide
tttcctataacagtatcact

SEQ ID NO: 982 - DNA, 20 bp, Artificial sequence
  Synthetic oligonucleotide
gtttcctataacagtatcac

SEQ ID NO: 983 - DNA, 20 bp, Artificial sequence
  Synthetic oligonucleotide
agtttcctataacagtatca

SEQ ID NO: 984 - DNA, 20 bp, Artificial sequence
  Synthetic oligonucleotide
tagtttcctataacagtatc

SEQ ID NO: 985 - DNA, 20 bp, Artificial sequence
  Synthetic oligonucleotide
ctagtttcctataacagtat

SEQ ID NO: 986 - DNA, 20 bp, Artificial sequence
  Synthetic oligonucleotide
actagtttcctataacagta

SEQ ID NO: 987 - DNA, 20 bp, Artificial sequence
  Synthetic oligonucleotide
gtatcactgtcctatatcac

SEQ ID NO: 988 - DNA, 20 bp, Artificial sequence
  Synthetic oligonucleotide
aacagtatcactgtcctata

SEQ ID NO: 989 - DNA, 20 bp, Artificial sequence
  Synthetic oligonucleotide
tataacagtatcactgtcct

SEQ ID NO: 990 - DNA, 20 bp, Artificial sequence
  Synthetic oligonucleotide
ctataacagtatcactgtcc

SEQ ID NO: 991 - DNA, 20 bp, Artificial sequence
  Synthetic oligonucleotide
actataacagtatcactgtc

SEQ ID NO: 992 - DNA, 20 bp, Artificial sequence
  Synthetic oligonucleotide
taactataacagtatcactg

SEQ ID NO: 993 - DNA, 20 bp, Artificial sequence
  Synthetic oligonucleotide
ataactataacagtatcact

SEQ ID NO: 994 - DNA, 20 bp, Artificial sequence
  Synthetic oligonucleotide
cctataactataacagtatc

SEQ ID NO: 995 - DNA, 20 bp, Artificial sequence
  Synthetic oligonucleotide
tcctataactataacagtat

SEQ ID NO: 996 - DNA, 20 bp, Artificial sequence
  Synthetic oligonucleotide
ttcctataactataacagta

SEQ ID NO: 997 - DNA, 20 bp, Artificial sequence
  Synthetic oligonucleotide
gtttcctataactataacag

SEQ ID NO: 998 - DNA, 20 bp, Artificial sequence
  Synthetic oligonucleotide
actagtttcctataactata

SEQ ID NO: 999 - DNA, 20 bp, Artificial sequence
  Synthetic oligonucleotide
tactagtttcctataactat

SEQ ID NO: 1000 - DNA, 20 bp, Artificial sequence
  Synthetic oligonucleotide
caatatcactgtcctatatc

SEQ ID NO: 1001 - DNA, 20 bp, Artificial sequence
  Synthetic oligonucleotide
actataacaatatcactgtc

SEQ ID NO: 1002 - DNA, 20 bp, Artificial sequence
  Synthetic oligonucleotide
ttcctataactataacaata

SEQ ID NO: 1003 - DNA, 20 bp, Artificial sequence
  Synthetic oligonucleotide
tttcctataactataacaat

SEQ ID NO: 1004 - DNA, 20 bp, Artificial sequence
  Synthetic oligonucleotide
gtacctataactctaacagt

SEQ ID NO: 1005 - DNA, 20 bp, Artificial sequence
  Synthetic oligonucleotide
tcactgtacctataactcta

SEQ ID NO: 1006 - DNA, 20 bp, Artificial sequence
  Synthetic oligonucleotide
tatcactgtacctataactc

SEQ ID NO: 1007 - DNA, 20 bp, Artificial sequence
  Synthetic oligonucleotide
atatcactgtacctataact

SEQ ID NO: 1008 - DNA, 20 bp, Artificial sequence
  Synthetic oligonucleotide
acaatatcactgtacctata

SEQ ID NO: 1009 - DNA, 20 bp, Artificial sequence
  Synthetic oligonucleotide
aacaatatcactgtacctat

SEQ ID NO: 1010 - DNA, 20 bp, Artificial sequence
  Synthetic oligonucleotide
taacaatatcactgtaccta

SEQ ID NO: 1011 - DNA, 20 bp, Artificial sequence
  Synthetic oligonucleotide
tataacaatatcactgtacc

SEQ ID NO: 1012 - DNA, 20 bp, Artificial sequence
  Synthetic oligonucleotide
ctataacaatatcactgtac

SEQ ID NO: 1013 - DNA, 20 bp, Artificial sequence
  Synthetic oligonucleotide
tgtaacagtatcactgtact

SEQ ID NO: 1014 - DNA, 20 bp, Artificial sequence
  Synthetic oligonucleotide
ctgtaacagtatcactgtac

SEQ ID NO: 1015 - DNA, 20 bp, Artificial sequence
  Synthetic oligonucleotide
cctgtaacagtatcactgta

SEQ ID NO: 1016 - DNA, 20 bp, Artificial sequence
  Synthetic oligonucleotide
ctatatcactgtacctgtaa

SEQ ID NO: 1017 - DNA, 20 bp, Artificial sequence
  Synthetic oligonucleotide
cctatatcactgtacctgta

SEQ ID NO: 1018 - DNA, 20 bp, Artificial sequence
  Synthetic oligonucleotide
tcctatatcactgtacctgt

SEQ ID NO: 1019 - DNA, 20 bp, Artificial sequence
  Synthetic oligonucleotide
tgtcctatatcactgtacct

SEQ ID NO: 1020 - DNA, 20 bp, Artificial sequence
  Synthetic oligonucleotide
ctgtcctatatcactgtacc

SEQ ID NO: 1021 - DNA, 20 bp, Artificial sequence
  Synthetic oligonucleotide
actgtcctatatcactgtac

SEQ ID NO: 1022 - DNA, 20 bp, Artificial sequence
  Synthetic oligonucleotide
tcctataacagtatcactgt

SEQ ID NO: 1023 - DNA, 20 bp, Artificial sequence
  Synthetic oligonucleotide
ttcctataacagtatcactg

SEQ ID NO: 1024 - DNA, 20 bp, Artificial sequence
  Synthetic oligonucleotide
tactagtttcctataacagt

SEQ ID NO: 1025 - DNA, 20 bp, Artificial sequence
  Synthetic oligonucleotide
gtcactgtacctataactct

SEQ ID NO: 1026 - DNA, 20 bp, Artificial sequence
  Synthetic oligonucleotide
tgtcactgtacctataactc

SEQ ID NO: 1027 - DNA, 20 bp, Artificial sequence
  Synthetic oligonucleotide
atgtcactgtacctataact

SEQ ID NO: 1028 - DNA, 20 bp, Artificial sequence
  Synthetic oligonucleotide
tatgtcactgtacctataac

SEQ ID NO: 1029 - DNA, 20 bp, Artificial sequence
  Synthetic oligonucleotide
ctatgtcactgtacctataa

SEQ ID NO: 1030 - DNA, 20 bp, Artificial sequence
  Synthetic oligonucleotide
cctatgtcactgtacctata

SEQ ID NO: 1031 - DNA, 20 bp, Artificial sequence
  Synthetic oligonucleotide
tcctatgtcactgtacctat

SEQ ID NO: 1032 - DNA, 20 bp, Artificial sequence
  Synthetic oligonucleotide
gtcctatgtcactgtaccta

SEQ ID NO: 1033 - DNA, 20 bp, Artificial sequence
  Synthetic oligonucleotide
tgtcctatgtcactgtacct

SEQ ID NO: 1034 - DNA, 20 bp, Artificial sequence
  Synthetic oligonucleotide
ctgtcctatgtcactgtacc

SEQ ID NO: 1035 - DNA, 20 bp, Artificial sequence
  Synthetic oligonucleotide
actgtcctatgtcactgtac

SEQ ID NO: 1036 - DNA, 20 bp, Artificial sequence
  Synthetic oligonucleotide
cactgtcctatgtcactgta

SEQ ID NO: 1037 - DNA, 20 bp, Artificial sequence
  Synthetic oligonucleotide
tcactgtcctatgtcactgt

SEQ ID NO: 1038 - DNA, 20 bp, Artificial sequence
  Synthetic oligonucleotide
tatcactgtcctatgtcact

SEQ ID NO: 1039 - DNA, 20 bp, Artificial sequence
  Synthetic oligonucleotide
gtatcactgtcctatgtcac

SEQ ID NO: 1040 - DNA, 20 bp, Artificial sequence
  Synthetic oligonucleotide
agtatcactgtcctatgtca

SEQ ID NO: 1041 - DNA, 20 bp, Artificial sequence
  Synthetic oligonucleotide
aacagtatcactgtcctatg

SEQ ID NO: 1042 - DNA, 20 bp, Artificial sequence
  Synthetic oligonucleotide
ctacctataactctaacagt

SEQ ID NO: 1043 - DNA, 20 bp, Artificial sequence
  Synthetic oligonucleotide
actgtcctataactataaca

SEQ ID NO: 1044 - DNA, 20 bp, Artificial sequence
  Synthetic oligonucleotide
cactgtcctataactataac

SEQ ID NO: 1045 - DNA, 20 bp, Artificial sequence
  Synthetic oligonucleotide
cctatatcactgtacctata

SEQ ID NO: 1046 - DNA, 20 bp, Artificial sequence
  Synthetic oligonucleotide
tcctatatcactgtacctat

SEQ ID NO: 1047 - DNA, 20 bp, Artificial sequence
  Synthetic oligonucleotide
tacctataacagtatcactg

SEQ ID NO: 1048 - DNA, 20 bp, Artificial sequence
  Synthetic oligonucleotide
ataactataacagtatcacc

SEQ ID NO: 1049 - DNA, 20 bp, Artificial sequence
  Synthetic oligonucleotide
tcactgtacctataactata

SEQ ID NO: 1050 - DNA, 20 bp, Artificial sequence
  Synthetic oligonucleotide
aacaatatcactgtaccttt

SEQ ID NO: 1051 - DNA, 20 bp, Artificial sequence
  Synthetic oligonucleotide
taacaatatcactgtacctt

SEQ ID NO: 1052 - DNA, 20 bp, Artificial sequence
  Synthetic oligonucleotide
gtcctataactataacaata

SEQ ID NO: 1053 - DNA, 20 bp, Artificial sequence
  Synthetic oligonucleotide
cagtatcactgtcctatgtc

SEQ ID NO: 1054 - DNA, 20 bp, Artificial sequence
  Synthetic oligonucleotide
acagtatcactgtcctatgt

SEQ ID NO: 1055 - DNA, 20 bp, Artificial sequence
  Synthetic oligonucleotide
tctacctataactctaacag

SEQ ID NO: 1056 - DNA, 20 bp, Artificial sequence
  Synthetic oligonucleotide
ctctacctataactctaaca

SEQ ID NO: 1057 - DNA, 20 bp, Artificial sequence
  Synthetic oligonucleotide
actctacctataactctaac

SEQ ID NO: 1058 - DNA, 20 bp, Artificial sequence
  Synthetic oligonucleotide
actgtcctatatcactctac

SEQ ID NO: 1059 - DNA, 20 bp, Artificial sequence
  Synthetic oligonucleotide
cactgtcctatatcactcta

SEQ ID NO: 1060 - DNA, 20 bp, Artificial sequence
  Synthetic oligonucleotide
tcactgtcctatatcactct

SEQ ID NO: 1061 - DNA, 20 bp, Artificial sequence
  Synthetic oligonucleotide
atcactgtcctatatcactc

SEQ ID NO: 1062 - DNA, 20 bp, Artificial sequence
  Synthetic oligonucleotide
atcactgtactagttttcta

SEQ ID NO: 1063 - DNA, 20 bp, Artificial sequence
  Synthetic oligonucleotide
tatcactgtactagttttct

SEQ ID NO: 1064 - DNA, 20 bp, Artificial sequence
  Synthetic oligonucleotide
gtatcactgtactagttttc

SEQ ID NO: 1065 - DNA, 20 bp, Artificial sequence
  Synthetic oligonucleotide
agtatcactgtactagtttt

SEQ ID NO: 1066 - DNA, 20 bp, Artificial sequence
  Synthetic oligonucleotide
ataacagtatcactgtacta

SEQ ID NO: 1067 - DNA, 20 bp, Artificial sequence
  Synthetic oligonucleotide
gtcctataactataacagta

SEQ ID NO: 1068 - DNA, 20 bp, Artificial sequence
  Synthetic oligonucleotide
tgtcctataactataacagt

SEQ ID NO: 1069 - DNA, 20 bp, Artificial sequence
  Synthetic oligonucleotide
ctgtcctataactataacag

SEQ ID NO: 1070 - DNA, 20 bp, Artificial sequence
  Synthetic oligonucleotide
tcactgtcctataactataa

SEQ ID NO: 1071 - DNA, 20 bp, Artificial sequence
  Synthetic oligonucleotide
atcactgtcctataactata

SEQ ID NO: 1072 - DNA, 20 bp, Artificial sequence
  Synthetic oligonucleotide
tatcactgtcctataactat

SEQ ID NO: 1073 - DNA, 20 bp, Artificial sequence
  Synthetic oligonucleotide
atatcactgtcctataacta

SEQ ID NO: 1074 - DNA, 20 bp, Artificial sequence
  Synthetic oligonucleotide
ctatatcactgtacctataa

SEQ ID NO: 1075 - DNA, 20 bp, Artificial sequence
  Synthetic oligonucleotide
gtcctatatcactgtaccta

SEQ ID NO: 1076 - DNA, 20 bp, Artificial sequence
  Synthetic oligonucleotide
cctataacagtatcactgta

SEQ ID NO: 1077 - DNA, 20 bp, Artificial sequence
  Synthetic oligonucleotide
acctataacagtatcactgt

SEQ ID NO: 1078 - DNA, 20 bp, Artificial sequence
  Synthetic oligonucleotide
gtacctataacagtatcact

SEQ ID NO: 1079 - DNA, 20 bp, Artificial sequence
  Synthetic oligonucleotide
tgtacctataacagtatcac

SEQ ID NO: 1080 - DNA, 20 bp, Artificial sequence
  Synthetic oligonucleotide
tcactgtacctataacagta

SEQ ID NO: 1081 - DNA, 20 bp, Artificial sequence
  Synthetic oligonucleotide
atcactgtacctataacagt

SEQ ID NO: 1082 - DNA, 20 bp, Artificial sequence
  Synthetic oligonucleotide
tatcactgtacctataacag

SEQ ID NO: 1083 - DNA, 20 bp, Artificial sequence
  Synthetic oligonucleotide
aatatcactgtcctataact

SEQ ID NO: 1084 - DNA, 20 bp, Artificial sequence
  Synthetic oligonucleotide
caatatcactgtcctataac

SEQ ID NO: 1085 - DNA, 20 bp, Artificial sequence
  Synthetic oligonucleotide
acaatatcactgtcctataa

SEQ ID NO: 1086 - DNA, 20 bp, Artificial sequence
  Synthetic oligonucleotide
cgtactagtttcctataact

SEQ ID NO: 1087 - DNA, 20 bp, Artificial sequence
  Synthetic oligonucleotide
actataacagtatcaccgta

SEQ ID NO: 1088 - DNA, 20 bp, Artificial sequence
  Synthetic oligonucleotide
aactataacagtatcaccgt

SEQ ID NO: 1089 - DNA, 20 bp, Artificial sequence
  Synthetic oligonucleotide
taactataacagtatcaccg

SEQ ID NO: 1090 - DNA, 20 bp, Artificial sequence
  Synthetic oligonucleotide
acctataactataacagtat

SEQ ID NO: 1091 - DNA, 20 bp, Artificial sequence
  Synthetic oligonucleotide
tacctataactataacagta

SEQ ID NO: 1092 - DNA, 20 bp, Artificial sequence
  Synthetic oligonucleotide
gtacctataactataacagt

SEQ ID NO: 1093 - DNA, 20 bp, Artificial sequence
  Synthetic oligonucleotide
tgtacctataactataacag

SEQ ID NO: 1094 - DNA, 20 bp, Artificial sequence
  Synthetic oligonucleotide
atcactgtacctataactat

SEQ ID NO: 1095 - DNA, 20 bp, Artificial sequence
  Synthetic oligonucleotide
tatcactgtacctataacta

SEQ ID NO: 1096 - DNA, 20 bp, Artificial sequence
  Synthetic oligonucleotide
caactataacagtatcactg

SEQ ID NO: 1097 - DNA, 20 bp, Artificial sequence
  Synthetic oligonucleotide
acaactataacagtatcact

SEQ ID NO: 1098 - DNA, 20 bp, Artificial sequence
  Synthetic oligonucleotide
tacaactataacagtatcac

SEQ ID NO: 1099 - DNA, 20 bp, Artificial sequence
  Synthetic oligonucleotide
ctacaactataacagtatca

SEQ ID NO: 1100 - DNA, 20 bp, Artificial sequence
  Synthetic oligonucleotide
caatatcactgtcctacaac

SEQ ID NO: 1101 - DNA, 20 bp, Artificial sequence
  Synthetic oligonucleotide
gaatatcactgtcctataac

SEQ ID NO: 1102 - DNA, 20 bp, Artificial sequence
  Synthetic oligonucleotide
acaatatcactgtaccttta

SEQ ID NO: 1103 - DNA, 20 bp, Artificial sequence
  Synthetic oligonucleotide
tgtcctataactataacaat

SEQ ID NO: 1104 - DNA, 20 bp, Artificial sequence
  Synthetic oligonucleotide
ctgtcctataactataacaa

SEQ ID NO: 1105 - DNA, 20 bp, Artificial sequence
  Synthetic oligonucleotide
gcacctggcagaacagtacc

SEQ ID NO: 1106 - DNA, 20 bp, Artificial sequence
  Synthetic oligonucleotide
gacagtgggccagagccttg

SEQ ID NO: 1107 - DNA, 20 bp, Artificial sequence
  Synthetic oligonucleotide
acatcactgtcctataacta

SEQ ID NO: 1108 - DNA, 20 bp, Artificial sequence
  Synthetic oligonucleotide
gtacctatatcactgtaact

SEQ ID NO: 1109 - DNA, 20 bp, Artificial sequence
  Synthetic oligonucleotide
atatcactgtacctatatca

SEQ ID NO: 1110 - DNA, 20 bp, Artificial sequence
  Synthetic oligonucleotide
tcactgtcctataactatat

SEQ ID NO: 1111 - DNA, 20 bp, Artificial sequence
  Synthetic oligonucleotide
cgtcactgtacctataactg

SEQ ID NO: 1112 - DNA, 20 bp, Artificial sequence
  Synthetic oligonucleotide
atcactgtcctataactatt

SEQ ID NO: 1113 - DNA, 20 bp, Artificial sequence
  Synthetic oligonucleotide
aacatcactgtacctataac

SEQ ID NO: 1114 - DNA, 20 bp, Artificial sequence
  Synthetic oligonucleotide
gccatccagggtgctctccc

SEQ ID NO: 1115 - DNA, 20 bp, Artificial sequence
  Synthetic oligonucleotide
gcccccggagcaccttcact

SEQ ID NO: 1116 - DNA, 20 bp, Artificial sequence
  Synthetic oligonucleotide
cgtggttagcctgacatctc

SEQ ID NO: 1117 - DNA, 20 bp, Artificial sequence
  Synthetic oligonucleotide
gccatctggttagcctccga

SEQ ID NO: 1118 - DNA, 20 bp, Artificial sequence
  Synthetic oligonucleotide
tacactgaacccccttaggc

SEQ ID NO: 1119 - DNA, 20 bp, Artificial sequence
  Synthetic oligonucleotide
cagtttggcctttccatctc

SEQ ID NO: 1120 - DNA, 20 bp, Artificial sequence
  Synthetic oligonucleotide
gccactaacccacctcttaa

SEQ ID NO: 1121 - DNA, 20 bp, Artificial sequence
  Synthetic oligonucleotide
actcccatctactcccccat

SEQ ID NO: 1122 - DNA, 20 bp, Artificial sequence
  Synthetic oligonucleotide
ctgctgattgtgtctggctc

SEQ ID NO: 1123 - DNA, 20 bp, Artificial sequence
  Synthetic oligonucleotide
acaaggcttcgaggacagcc

SEQ ID NO: 1124 - DNA, 20 bp, Artificial sequence
  Synthetic oligonucleotide
gcgattccttgcctctgctg

SEQ ID NO: 1125 - DNA, 20 bp, Artificial sequence
  Synthetic oligonucleotide
caccgcgcgaatgcctgcct

SEQ ID NO: 1126 - DNA, 20 bp, Artificial sequence
  Synthetic oligonucleotide
atccaacctctctccctatc

SEQ ID NO: 1127 - DNA, 20 bp, Artificial sequence
  Synthetic oligonucleotide
gcccaagcctacatgcatac

SEQ ID NO: 1128 - DNA, 20 bp, Artificial sequence
  Synthetic oligonucleotide
ggcctggatacagcctttct

SEQ ID NO: 1129 - DNA, 20 bp, Artificial sequence
  Synthetic oligonucleotide
gtcccgaagagtcaagtcca

SEQ ID NO: 1130 - DNA, 20 bp, Artificial sequence
  Synthetic oligonucleotide
actgttgtccatagcagcat

SEQ ID NO: 1131 - DNA, 20 bp, Artificial sequence
  Synthetic oligonucleotide
agccctcaattgttgctggt

SEQ ID NO: 1132 - DNA, 20 bp, Artificial sequence
  Synthetic oligonucleotide
gatgacctgcagatgcacag

SEQ ID NO: 1133 - DNA, 20 bp, Artificial sequence
  Synthetic oligonucleotide
caggatagaactgatggtcc

SEQ ID NO: 1134 - DNA, 20 bp, Artificial sequence
  Synthetic oligonucleotide
agaacaggagacaatccact

SEQ ID NO: 1135 - DNA, 20 bp, Artificial sequence
  Synthetic oligonucleotide
gttcatgtggcaacctgtga

SEQ ID NO: 1136 - DNA, 20 bp, Artificial sequence
  Synthetic oligonucleotide
catcactgtcctataactat

SEQ ID NO: 1137 - DNA, 20 bp, Artificial sequence
  Synthetic oligonucleotide
tacctatatcactgtaacta

SEQ ID NO: 1138 - DNA, 20 bp, Artificial sequence
  Synthetic oligonucleotide
tgtacctatatcactgtaac

SEQ ID NO: 1139 - DNA, 20 bp, Artificial sequence
  Synthetic oligonucleotide
tatcactgtacctatatcac

SEQ ID NO: 1140 - DNA, 20 bp, Artificial sequence
  Synthetic oligonucleotide
aatatcactgtacctatatc

SEQ ID NO: 1141 - DNA, 20 bp, Artificial sequence
  Synthetic oligonucleotide
caatatcactgtacctatat

SEQ ID NO: 1142 - DNA, 20 bp, Artificial sequence
  Synthetic oligonucleotide
actatatcactgtcctataa

SEQ ID NO: 1143 - DNA, 20 bp, Artificial sequence
  Synthetic oligonucleotide
taactatatcactgtcctat

SEQ ID NO: 1144 - DNA, 20 bp, Artificial sequence
  Synthetic oligonucleotide
ataactatatcactgtccta

SEQ ID NO: 1145 - DNA, 20 bp, Artificial sequence
  Synthetic oligonucleotide
ctgtcctataactatatcac

SEQ ID NO: 1146 - DNA, 20 bp, Artificial sequence
  Synthetic oligonucleotide
actgtcctataactatatca

SEQ ID NO: 1147 - DNA, 20 bp, Artificial sequence
  Synthetic oligonucleotide
cactgtcctataactatatc

SEQ ID NO: 1148 - DNA, 20 bp, Artificial sequence
  Synthetic oligonucleotide
gtaacaatatcactgtccta

SEQ ID NO: 1149 - DNA, 20 bp, Artificial sequence
  Synthetic oligonucleotide
ctgtaacaatatcactgtcc

SEQ ID NO: 1150 - DNA, 20 bp, Artificial sequence
  Synthetic oligonucleotide
actgtaacaatatcactgtc

SEQ ID NO: 1151 - DNA, 20 bp, Artificial sequence
  Synthetic oligonucleotide
cactgtacctataactgtaa

SEQ ID NO: 1152 - DNA, 20 bp, Artificial sequence
  Synthetic oligonucleotide
tcactgtacctataactgta

SEQ ID NO: 1153 - DNA, 20 bp, Artificial sequence
  Synthetic oligonucleotide
gtcactgtacctataactgt

SEQ ID NO: 1154 - DNA, 20 bp, Artificial sequence
  Synthetic oligonucleotide
actgtcctataactattaca

SEQ ID NO: 1155 - DNA, 20 bp, Artificial sequence
  Synthetic oligonucleotide
cactgtcctataactattac

SEQ ID NO: 1156 - DNA, 20 bp, Artificial sequence
  Synthetic oligonucleotide
tcactgtcctataactatta

SEQ ID NO: 1157 - DNA, 20 bp, Artificial sequence
  Synthetic oligonucleotide
acctataactataacaatat

SEQ ID NO: 1158 - DNA, 20 bp, Artificial sequence
  Synthetic oligonucleotide
tacctataactataacaata

SEQ ID NO: 1159 - DNA, 20 bp, Artificial sequence
  Synthetic oligonucleotide
gtacctataactataacaat

SEQ ID NO: 1160 - DNA, 20 bp, Artificial sequence
  Synthetic oligonucleotide
catcactgtacctataacta

SEQ ID NO: 1161 - DNA, 20 bp, Artificial sequence
  Synthetic oligonucleotide
acatcactgtacctataact

SEQ ID NO: 1162 - DNA, 20 bp, Artificial sequence
  Synthetic oligonucleotide
caacatcactgtacctataa

SEQ ID NO: 1163 - DNA, 20 bp, Artificial sequence
  Synthetic oligonucleotide
acatcttgtcattaacatcc

SEQ ID NO: 1164 - DNA, 20 bp, Artificial sequence
  Synthetic oligonucleotide
gcacccaatacagggccagg

SEQ ID NO: 1165 - DNA, 20 bp, Artificial sequence
  Synthetic oligonucleotide
tgcctcctggcagccttcaa

SEQ ID NO: 1166 - DNA, 20 bp, Artificial sequence
  Synthetic oligonucleotide
tgaaaagccacgcccttagc

SEQ ID NO: 1167 - DNA, 20 bp, Artificial sequence
  Synthetic oligonucleotide
gccaggagacagccctactc

SEQ ID NO: 1168 - DNA, 20 bp, Artificial sequence
  Synthetic oligonucleotide
agcccaatgtcctaacctgt

SEQ ID NO: 1169 - DNA, 20 bp, Artificial sequence
  Synthetic oligonucleotide
tgcggttatatgggctgaag

SEQ ID NO: 1170 - DNA, 20 bp, Artificial sequence
  Synthetic oligonucleotide
cctttagccactcctcttgc

SEQ ID NO: 1171 - DNA, 20 bp, Artificial sequence
  Synthetic oligonucleotide
ccccatggtaccaaagccat

SEQ ID NO: 1172 - DNA, 20 bp, Artificial sequence
  Synthetic oligonucleotide
ctcaatgccaccctttcccc

SEQ ID NO: 1173 - DNA, 20 bp, Artificial sequence
  Synthetic oligonucleotide
ctgtctaactggcctggctg

SEQ ID NO: 1174 - DNA, 20 bp, Artificial sequence
  Synthetic oligonucleotide
ggtcagaaggcctcttattc

SEQ ID NO: 1175 - DNA, 20 bp, Artificial sequence
  Synthetic oligonucleotide
ccatctgtcccctcaatccc

SEQ ID NO: 1176 - DNA, 20 bp, Artificial sequence
  Synthetic oligonucleotide
actctggcactggtcatgga

SEQ ID NO: 1177 - DNA, 20 bp, Artificial sequence
  Synthetic oligonucleotide
ataaagtgcgattaagcccc

SEQ ID NO: 1178 - DNA, 20 bp, Artificial sequence
  Synthetic oligonucleotide
taccaagcttgtagaaggga

SEQ ID NO: 1179 - DNA, 20 bp, Artificial sequence
  Synthetic oligonucleotide
gaaagacggccaatgggaaa

SEQ ID NO: 1180 - DNA, 20 bp, Artificial sequence
  Synthetic oligonucleotide
ctctatcaaaatcctgctgc

SEQ ID NO: 1181 - DNA, 20 bp, Artificial sequence
  Synthetic oligonucleotide
ctccagtcaccaccattgcc

SEQ ID NO: 1182 - DNA, 20 bp, Artificial sequence
  Synthetic oligonucleotide
aagagtaagccttcacaggg

SEQ ID NO: 1183 - DNA, 20 bp, Artificial sequence
  Synthetic oligonucleotide
ctcaccagagttgtccccag

SEQ ID NO: 1184 - DNA, 20 bp, Artificial sequence
  Synthetic oligonucleotide
gcagctcacacccaaaaagc

SEQ ID NO: 1185 - DNA, 20 bp, Artificial sequence
  Synthetic oligonucleotide
tctgttaccttgaggattgt

SEQ ID NO: 1186 - DNA, 20 bp, Artificial sequence
  Synthetic oligonucleotide
cgccatctgccctgtacaga

SEQ ID NO: 1187 - DNA, 20 bp, Artificial sequence
  Synthetic oligonucleotide
ttggtggtgggattggtggt

SEQ ID NO: 1188 - DNA, 20 bp, Artificial sequence
  Synthetic oligonucleotide
aattggtggtgggattggtg

SEQ ID NO: 1189 - DNA, 20 bp, Artificial sequence
  Synthetic oligonucleotide
gaattggtggtgggattggt

SEQ ID NO: 1190 - DNA, 20 bp, Artificial sequence
  Synthetic oligonucleotide
ggcaggattggtggtggaat

SEQ ID NO: 1191 - DNA, 20 bp, Artificial sequence
  Synthetic oligonucleotide
tgagattggtggtgggtggc

SEQ ID NO: 1192 - DNA, 20 bp, Artificial sequence
  Synthetic oligonucleotide
ggtggtgggattggtgctga

SEQ ID NO: 1193 - DNA, 20 bp, Artificial sequence
  Synthetic oligonucleotide
gtaggtggtgggattggtgg

SEQ ID NO: 1194 - DNA, 20 bp, Artificial sequence
  Synthetic oligonucleotide
ggtaggtggtgggattggtg

SEQ ID NO: 1195 - DNA, 20 bp, Artificial sequence
  Synthetic oligonucleotide
ggtggcgggattggtggtgg

SEQ ID NO: 1196 - DNA, 20 bp, Artificial sequence
  Synthetic oligonucleotide
gatcggtggtgggattggtc

SEQ ID NO: 1197 - DNA, 20 bp, Artificial sequence
  Synthetic oligonucleotide
ggatcggtggtgggattggt

SEQ ID NO: 1198 - DNA, 20 bp, Artificial sequence
  Synthetic oligonucleotide
ttggtggcgggatcggtggt

SEQ ID NO: 1199 - DNA, 20 bp, Artificial sequence
  Synthetic oligonucleotide
attggtggcgggatcggtgg

SEQ ID NO: 1200 - DNA, 20 bp, Artificial sequence
  Synthetic oligonucleotide
gattggtggcgggatcggtg

SEQ ID NO: 1201 - DNA, 20 bp, Artificial sequence
  Synthetic oligonucleotide
ggattggtggcgggatcggt

SEQ ID NO: 1202 - DNA, 20 bp, Artificial sequence
  Synthetic oligonucleotide
tggtggtgggattggtggtt

SEQ ID NO: 1203 - DNA, 20 bp, Artificial sequence
  Synthetic oligonucleotide
tcttctagggccacacctct

SEQ ID NO: 1204 - DNA, 20 bp, Artificial sequence
  Synthetic oligonucleotide
tggtcccaaattggagtgca

SEQ ID NO: 1205 - DNA, 20 bp, Artificial sequence
  Synthetic oligonucleotide
tctctatacagctgggcaca

SEQ ID NO: 1206 - DNA, 20 bp, Artificial sequence
  Synthetic oligonucleotide
cacttcccagcaaccctcac

SEQ ID NO: 1207 - DNA, 20 bp, Artificial sequence
  Synthetic oligonucleotide
gctcctggcagcaatgaccc

SEQ ID NO: 1208 - DNA, 20 bp, Artificial sequence
  Synthetic oligonucleotide
gggtatcttcactgttccag

SEQ ID NO: 1209 - DNA, 20 bp, Artificial sequence
  Synthetic oligonucleotide
cgtcatgcttacctttctcc

SEQ ID NO: 1210 - DNA, 20 bp, Artificial sequence
  Synthetic oligonucleotide
gccctccgagctttggcaac

SEQ ID NO: 1211 - DNA, 20 bp, Artificial sequence
  Synthetic oligonucleotide
gcagccccccagaaatccca

SEQ ID NO: 1212 - DNA, 20 bp, Artificial sequence
  Synthetic oligonucleotide
tctcaagcagcctattgtgt

SEQ ID NO: 1213 - DNA, 20 bp, Artificial sequence
  Synthetic oligonucleotide
gtgcaagaccttgcttgcca

SEQ ID NO: 1214 - DNA, 20 bp, Artificial sequence
  Synthetic oligonucleotide
ctgtagtccactacacagca

SEQ ID NO: 1215 - DNA, 20 bp, Artificial sequence
  Synthetic oligonucleotide
tctccctgagtcacagtgga

SEQ ID NO: 1216 - DNA, 20 bp, Artificial sequence
  Synthetic oligonucleotide
ccaggtgcagcacggagagg

SEQ ID NO: 1217 - DNA, 20 bp, Artificial sequence
  Synthetic oligonucleotide
tagaatggcagggttctgtg

SEQ ID NO: 1218 - DNA, 20 bp, Artificial sequence
  Synthetic oligonucleotide
gatgcatccaacacttaccc

SEQ ID NO: 1219 - DNA, 20 bp, Artificial sequence
  Synthetic oligonucleotide
attggtggtgggattggtgg

SEQ ID NO: 1220 - DNA, 20 bp, Artificial sequence
  Synthetic oligonucleotide
gcaggattggtggtggaatt

SEQ ID NO: 1221 - DNA, 20 bp, Artificial sequence
  Synthetic oligonucleotide
tggcaggattggtggtggaa

SEQ ID NO: 1222 - DNA, 20 bp, Artificial sequence
  Synthetic oligonucleotide
gagattggtggtgggtggca

SEQ ID NO: 1223 - DNA, 20 bp, Artificial sequence
  Synthetic oligonucleotide
gtgagattggtggtgggtgg

SEQ ID NO: 1224 - DNA, 20 bp, Artificial sequence
  Synthetic oligonucleotide
gattggtggtgggattggtg

SEQ ID NO: 1225 - DNA, 20 bp, Artificial sequence
  Synthetic oligonucleotide
ggattggtggtgggattggt

SEQ ID NO: 1226 - DNA, 20 bp, Artificial sequence
  Synthetic oligonucleotide
aggattggtggtgggattgg

SEQ ID NO: 1227 - DNA, 20 bp, Artificial sequence
  Synthetic oligonucleotide
taggattggtggtgggattg

SEQ ID NO: 1228 - DNA, 20 bp, Artificial sequence
  Synthetic oligonucleotide
gtaggattggtggtgggatt

SEQ ID NO: 1229 - DNA, 20 bp, Artificial sequence
  Synthetic oligonucleotide
ggtaggattggtggtgggat

SEQ ID NO: 1230 - DNA, 20 bp, Artificial sequence
  Synthetic oligonucleotide
tggtaggattggtggtggga

SEQ ID NO: 1231 - DNA, 20 bp, Artificial sequence
  Synthetic oligonucleotide
tggtggtgggattggtgctg

SEQ ID NO: 1232 - DNA, 20 bp, Artificial sequence
  Synthetic oligonucleotide
ttggtggtgggattggtgct

SEQ ID NO: 1233 - DNA, 20 bp, Artificial sequence
  Synthetic oligonucleotide
attggtggtgggattggtgc

SEQ ID NO: 1234 - DNA, 20 bp, Artificial sequence
  Synthetic oligonucleotide
aggtggtgggattggtggtg

SEQ ID NO: 1235 - DNA, 20 bp, Artificial sequence
  Synthetic oligonucleotide
taggtggtgggattggtggt

SEQ ID NO: 1236 - DNA, 20 bp, Artificial sequence
  Synthetic oligonucleotide
atcggtggtgggattggtcg

SEQ ID NO: 1237 - DNA, 20 bp, Artificial sequence
  Synthetic oligonucleotide
ggtggtgggattggtggcgg

SEQ ID NO: 1238 - DNA, 20 bp, Artificial sequence
  Synthetic oligonucleotide
tggtggtgggattggtggcg

SEQ ID NO: 1239 - DNA, 20 bp, Artificial sequence
  Synthetic oligonucleotide
ttggtggtgggattggtggc

SEQ ID NO: 1240 - DNA, 20 bp, Artificial sequence
  Synthetic oligonucleotide
gttggtggcgggatcggtgg

SEQ ID NO: 1241 - DNA, 20 bp, Artificial sequence
  Synthetic oligonucleotide
ggttggtggcgggatcggtg

SEQ ID NO: 1242 - DNA, 20 bp, Artificial sequence
  Synthetic oligonucleotide
tggttggtggcgggatcggt

SEQ ID NO: 1243 - DNA, 20 bp, Artificial sequence
  Synthetic oligonucleotide
gtggttggtggcgggatcgg

SEQ ID NO: 1244 - DNA, 20 bp, Artificial sequence
  Synthetic oligonucleotide
gggattggtggttggtggcg

SEQ ID NO: 1245 - DNA, 20 bp, Artificial sequence
  Synthetic oligonucleotide
gggtcttgctccacccacat

SEQ ID NO: 1246 - DNA, 20 bp, Artificial sequence
  Synthetic oligonucleotide
ccaagtagtgcaaggcatgt

SEQ ID NO: 1247 - DNA, 20 bp, Artificial sequence
  Synthetic oligonucleotide
atcatgcttactgcaagtga

SEQ ID NO: 1248 - DNA, 20 bp, Artificial sequence
  Synthetic oligonucleotide
tgaaactgggcagtccttcc

SEQ ID NO: 1249 - DNA, 20 bp, Artificial sequence
  Synthetic oligonucleotide
ccaccttcttacatatgcta

SEQ ID NO: 1250 - DNA, 20 bp, Artificial sequence
  Synthetic oligonucleotide
gcctctcagacggcacagac

SEQ ID NO: 1251 - DNA, 20 bp, Artificial sequence
  Synthetic oligonucleotide
ttgccctcacacattcgaat

SEQ ID NO: 1252 - DNA, 20 bp, Artificial sequence
  Synthetic oligonucleotide
tgctttctgcccaacctcta

SEQ ID NO: 1253 - DNA, 20 bp, Artificial sequence
  Synthetic oligonucleotide
ctgtgctcccggccattagc

SEQ ID NO: 1254 - DNA, 20 bp, Artificial sequence
  Synthetic oligonucleotide
gagacagtttggcaagctac

SEQ ID NO: 1255 - DNA, 20 bp, Artificial sequence
  Synthetic oligonucleotide
ggagagagacggcaccctgt

SEQ ID NO: 1256 - DNA, 20 bp, Artificial sequence
  Synthetic oligonucleotide
tcacctgtgagtaaccaata

SEQ ID NO: 1257 - DNA, 20 bp, Artificial sequence
  Synthetic oligonucleotide
cccctcttaaatagcacatg

SEQ ID NO: 1258 - DNA, 20 bp, Artificial sequence
  Synthetic oligonucleotide
ccaagtatctcatgtgcctg

SEQ ID NO: 1259 - DNA, 16 bp, Artificial sequence
  Synthetic oligonucleotide
ctagtttcctataact

SEQ ID NO: 1260 - DNA, 16 bp, Artificial sequence
  Synthetic oligonucleotide
actagtttcctataac

SEQ ID NO: 1261 - DNA, 16 bp, Artificial sequence
  Synthetic oligonucleotide
tactagtttcctataa

SEQ ID NO: 1262 - DNA, 16 bp, Artificial sequence
  Synthetic oligonucleotide
gtactagtttcctata

SEQ ID NO: 1263 - DNA, 16 bp, Artificial sequence
  Synthetic oligonucleotide
tgtactagtttcctat

SEQ ID NO: 1264 - DNA, 16 bp, Artificial sequence
  Synthetic oligonucleotide
ctgtactagtttccta

SEQ ID NO: 1265 - DNA, 16 bp, Artificial sequence
  Synthetic oligonucleotide
actgtactagtttcct

SEQ ID NO: 1266 - DNA, 16 bp, Artificial sequence
  Synthetic oligonucleotide
cactgtactagtttcc

SEQ ID NO: 1267 - DNA, 16 bp, Artificial sequence
  Synthetic oligonucleotide
tcactgtactagtttc

SEQ ID NO: 1268 - DNA, 16 bp, Artificial sequence
  Synthetic oligonucleotide
atcactgtactagttt

SEQ ID NO: 1269 - DNA, 16 bp, Artificial sequence
  Synthetic oligonucleotide
tatcactgtactagtt

SEQ ID NO: 1270 - DNA, 17 bp, Artificial sequence
  Synthetic oligonucleotide
actagtttcctataact

SEQ ID NO: 1271 - DNA, 17 bp, Artificial sequence
  Synthetic oligonucleotide
tactagtttcctataac

SEQ ID NO: 1272 - DNA, 17 bp, Artificial sequence
  Synthetic oligonucleotide
gtactagtttcctataa

SEQ ID NO: 1273 - DNA, 17 bp, Artificial sequence
  Synthetic oligonucleotide
tgtactagtttcctata

SEQ ID NO: 1274 - DNA, 17 bp, Artificial sequence
  Synthetic oligonucleotide
ctgtactagtttcctat

SEQ ID NO: 1275 - DNA, 17 bp, Artificial sequence
  Synthetic oligonucleotide
actgtactagtttccta

SEQ ID NO: 1276 - DNA, 17 bp, Artificial sequence
  Synthetic oligonucleotide
cactgtactagtttcct

SEQ ID NO: 1277 - DNA, 17 bp, Artificial sequence
  Synthetic oligonucleotide
tcactgtactagtttcc

SEQ ID NO: 1278 - DNA, 17 bp, Artificial sequence
  Synthetic oligonucleotide
atcactgtactagtttc

SEQ ID NO: 1279 - DNA, 17 bp, Artificial sequence
  Synthetic oligonucleotide
tatcactgtactagttt

SEQ ID NO: 1280 - DNA, 18 bp, Artificial sequence
  Synthetic oligonucleotide
tactagtttcctataact

SEQ ID NO: 1281 - DNA, 18 bp, Artificial sequence
  Synthetic oligonucleotide
gtactagtttcctataac

SEQ ID NO: 1282 - DNA, 18 bp, Artificial sequence
  Synthetic oligonucleotide
tgtactagtttcctataa

SEQ ID NO: 1283 - DNA, 18 bp, Artificial sequence
  Synthetic oligonucleotide
ctgtactagtttcctata

SEQ ID NO: 1284 - DNA, 18 bp, Artificial sequence
  Synthetic oligonucleotide
actgtactagtttcctat

SEQ ID NO: 1285 - DNA, 18 bp, Artificial sequence
  Synthetic oligonucleotide
cactgtactagtttccta

SEQ ID NO: 1286 - DNA, 18 bp, Artificial sequence
  Synthetic oligonucleotide
tcactgtactagtttcct

SEQ ID NO: 1287 - DNA, 18 bp, Artificial sequence
  Synthetic oligonucleotide
atcactgtactagtttcc

SEQ ID NO: 1288 - DNA, 18 bp, Artificial sequence
  Synthetic oligonucleotide
tatcactgtactagtttc

SEQ ID NO: 1289 - DNA, 17 bp, Artificial sequence
  Synthetic oligonucleotide
gtatcactgtactagtt

SEQ ID NO: 1290 - DNA, 17 bp, Artificial sequence
  Synthetic oligonucleotide
agtatcactgtactagt

SEQ ID NO: 1291 - DNA, 17 bp, Artificial sequence
  Synthetic oligonucleotide
cagtatcactgtactag

SEQ ID NO: 1292 - DNA, 17 bp, Artificial sequence
  Synthetic oligonucleotide
aacagtatcactgtact

SEQ ID NO: 1293 - DNA, 17 bp, Artificial sequence
  Synthetic oligonucleotide
taacagtatcactgtac

SEQ ID NO: 1294 - DNA, 17 bp, Artificial sequence
  Synthetic oligonucleotide
ctaacagtatcactgta

SEQ ID NO: 1295 - DNA, 17 bp, Artificial sequence
  Synthetic oligonucleotide
tctaacagtatcactgt

SEQ ID NO: 1296 - DNA, 17 bp, Artificial sequence
  Synthetic oligonucleotide
ctctaacagtatcactg

SEQ ID NO: 1297 - DNA, 17 bp, Artificial sequence
  Synthetic oligonucleotide
tatcactgtcctataac

SEQ ID NO: 1298 - DNA, 17 bp, Artificial sequence
  Synthetic oligonucleotide
atatcactgtcctataa

SEQ ID NO: 1299 - DNA, 17 bp, Artificial sequence
  Synthetic oligonucleotide
tatatcactgtcctata

SEQ ID NO: 1300 - DNA, 17 bp, Artificial sequence
  Synthetic oligonucleotide
tatcactgtcctatatc

SEQ ID NO: 1301 - DNA, 17 bp, Artificial sequence
  Synthetic oligonucleotide
gtatcactgtcctatat

SEQ ID NO: 1302 - DNA, 17 bp, Artificial sequence
  Synthetic oligonucleotide
agtatcactgtcctata

SEQ ID NO: 1303 - DNA, 17 bp, Artificial sequence
  Synthetic oligonucleotide
taacagtatcactgtcc

SEQ ID NO: 1304 - DNA, 17 bp, Artificial sequence
  Synthetic oligonucleotide
ataacagtatcactgtc

SEQ ID NO: 1305 - DNA, 17 bp, Artificial sequence
  Synthetic oligonucleotide
tataacagtatcactgt

SEQ ID NO: 1306 - DNA, 17 bp, Artificial sequence
  Synthetic oligonucleotide
ctataacagtatcactg

SEQ ID NO: 1307 - DNA, 17 bp, Artificial sequence
  Synthetic oligonucleotide
cctataactataacagt

SEQ ID NO: 1308 - DNA, 17 bp, Artificial sequence
  Synthetic oligonucleotide
tcctataactataacag

SEQ ID NO: 1309 - DNA, 17 bp, Artificial sequence
  Synthetic oligonucleotide
cctataactataacaat

SEQ ID NO: 1310 - DNA, 17 bp, Artificial sequence
  Synthetic oligonucleotide
gtaacagtatcactgta

SEQ ID NO: 1311 - DNA, 17 bp, Artificial sequence
  Synthetic oligonucleotide
ataacagtatcactgta

SEQ ID NO: 1312 - DNA, 17 bp, Artificial sequence
  Synthetic oligonucleotide
gtcctataactataaca

SEQ ID NO: 1313 - DNA, 17 bp, Artificial sequence
  Synthetic oligonucleotide
tgtcctataactataac

SEQ ID NO: 1314 - DNA, 17 bp, Artificial sequence
  Synthetic oligonucleotide
acctataactataacag

SEQ ID NO: 1315 - DNA, 17 bp, Artificial sequence
  Synthetic oligonucleotide
tacctataactataaca

SEQ ID NO: 1316 - DNA, 17 bp, Artificial sequence
  Synthetic oligonucleotide
acctataactataacaa

SEQ ID NO: 1317 - DNA, 16 bp, Artificial sequence
  Synthetic oligonucleotide
cctttctccttcgaga

SEQ ID NO: 1318 - DNA, 16 bp, Artificial sequence
  Synthetic oligonucleotide
acctttctccttcgag

SEQ ID NO: 1319 - DNA, 16 bp, Artificial sequence
  Synthetic oligonucleotide
cacctttctccttcga

SEQ ID NO: 1320 - DNA, 16 bp, Artificial sequence
  Synthetic oligonucleotide
atttgttaccaaagga

SEQ ID NO: 1321 - DNA, 16 bp, Artificial sequence
  Synthetic oligonucleotide
tcttcatttgttacca

SEQ ID NO: 1322 - DNA, 16 bp, Artificial sequence
  Synthetic oligonucleotide
ccttctttatagccag

SEQ ID NO: 1323 - DNA, 16 bp, Artificial sequence
  Synthetic oligonucleotide
cccttctttatagcca

SEQ ID NO: 1324 - DNA, 16 bp, Artificial sequence
  Synthetic oligonucleotide
ccccttctttatagcc

SEQ ID NO: 1325 - DNA, 16 bp, Artificial sequence
  Synthetic oligonucleotide
aagcatcttttccccc

SEQ ID NO: 1326 - DNA, 16 bp, Artificial sequence
  Synthetic oligonucleotide
agggaccacctgaatc

SEQ ID NO: 1327 - DNA, 16 bp, Artificial sequence
  Synthetic oligonucleotide
aagggaccacctgaat

SEQ ID NO: 1328 - DNA, 16 bp, Artificial sequence
  Synthetic oligonucleotide
taagggaccacctgaa

SEQ ID NO: 1329 - DNA, 16 bp, Artificial sequence
  Synthetic oligonucleotide
ctaagggaccacctga

SEQ ID NO: 1330 - DNA, 16 bp, Artificial sequence
  Synthetic oligonucleotide
actaagggaccacctg

SEQ ID NO: 1331 - DNA, 16 bp, Artificial sequence
  Synthetic oligonucleotide
aactaagggaccacct

SEQ ID NO: 1332 - DNA, 16 bp, Artificial sequence
  Synthetic oligonucleotide
aaactaagggaccacc

SEQ ID NO: 1333 - DNA, 16 bp, Artificial sequence
  Synthetic oligonucleotide
caaactaagggaccac

SEQ ID NO: 1334 - DNA, 16 bp, Artificial sequence
  Synthetic oligonucleotide
tgcaaactaagggacc

SEQ ID NO: 1335 - DNA, 16 bp, Artificial sequence
  Synthetic oligonucleotide
ttgcaaactaagggac

SEQ ID NO: 1336 - DNA, 16 bp, Artificial sequence
  Synthetic oligonucleotide
tttgcaaactaaggga

SEQ ID NO: 1337 - DNA, 16 bp, Artificial sequence
  Synthetic oligonucleotide
gtttgcaaactaaggg

SEQ ID NO: 1338 - DNA, 16 bp, Artificial sequence
  Synthetic oligonucleotide
tgtttgcaaactaagg

SEQ ID NO: 1339 - DNA, 16 bp, Artificial sequence
  Synthetic oligonucleotide
gtgtttgcaaactaag

SEQ ID NO: 1340 - DNA, 16 bp, Artificial sequence
  Synthetic oligonucleotide
tgctccctgcgggcac

SEQ ID NO: 1341 - DNA, 16 bp, Artificial sequence
  Synthetic oligonucleotide
agacaccaggttgctc

SEQ ID NO: 1342 - DNA, 16 bp, Artificial sequence
  Synthetic oligonucleotide
ctcagcgactttggtg

SEQ ID NO: 1343 - DNA, 16 bp, Artificial sequence
  Synthetic oligonucleotide
actcagcgactttggt

SEQ ID NO: 1344 - DNA, 16 bp, Artificial sequence
  Synthetic oligonucleotide
tactcagcgactttgg

SEQ ID NO: 1345 - DNA, 16 bp, Artificial sequence
  Synthetic oligonucleotide
gtactcagcgactttg

SEQ ID NO: 1346 - DNA, 16 bp, Artificial sequence
  Synthetic oligonucleotide
tgtactcagcgacttt

SEQ ID NO: 1347 - DNA, 16 bp, Artificial sequence
  Synthetic oligonucleotide
atgtactcagcgactt

SEQ ID NO: 1348 - DNA, 16 bp, Artificial sequence
  Synthetic oligonucleotide
catgtactcagcgact

SEQ ID NO: 1349 - DNA, 16 bp, Artificial sequence
  Synthetic oligonucleotide
ccatgtactcagcgac

SEQ ID NO: 1350 - DNA, 16 bp, Artificial sequence
  Synthetic oligonucleotide
tccatgtactcagcga

SEQ ID NO: 1351 - DNA, 16 bp, Artificial sequence
  Synthetic oligonucleotide
gagcttttccatcact

SEQ ID NO: 1352 - DNA, 16 bp, Artificial sequence
  Synthetic oligonucleotide
gcatctgagcttttcc

SEQ ID NO: 1353 - DNA, 16 bp, Artificial sequence
  Synthetic oligonucleotide
tgcatctgagcttttc

SEQ ID NO: 1354 - DNA, 16 bp, Artificial sequence
  Synthetic oligonucleotide
gactgcatctgagctt

SEQ ID NO: 1355 - DNA, 16 bp, Artificial sequence
  Synthetic oligonucleotide
gtgactgcatctgagc

SEQ ID NO: 1356 - DNA, 16 bp, Artificial sequence
  Synthetic oligonucleotide
ggtgactgcatctgag

SEQ ID NO: 1357 - DNA, 16 bp, Artificial sequence
  Synthetic oligonucleotide
tggtgactgcatctga

SEQ ID NO: 1358 - DNA, 16 bp, Artificial sequence
  Synthetic oligonucleotide
catgctggtgactgca

SEQ ID NO: 1359 - DNA, 16 bp, Artificial sequence
  Synthetic oligonucleotide
tcatgctggtgactgc

SEQ ID NO: 1360 - DNA, 16 bp, Artificial sequence
  Synthetic oligonucleotide
ctcatgctggtgactg

SEQ ID NO: 1361 - DNA, 16 bp, Artificial sequence
  Synthetic oligonucleotide
tctcatgctggtgact

SEQ ID NO: 1362 - DNA, 16 bp, Artificial sequence
  Synthetic oligonucleotide
tggactgcttctcatg

SEQ ID NO: 1363 - DNA, 16 bp, Artificial sequence
  Synthetic oligonucleotide
tctggactgcttctca

SEQ ID NO: 1364 - DNA, 16 bp, Artificial sequence
  Synthetic oligonucleotide
ctctggactgcttctc

SEQ ID NO: 1365 - DNA, 16 bp, Artificial sequence
  Synthetic oligonucleotide
agactctggactgctt

SEQ ID NO: 1366 - DNA, 16 bp, Artificial sequence
  Synthetic oligonucleotide
tagactctggactgct

SEQ ID NO: 1367 - DNA, 16 bp, Artificial sequence
  Synthetic oligonucleotide
ctagactctggactgc

SEQ ID NO: 1368 - DNA, 16 bp, Artificial sequence
  Synthetic oligonucleotide
tgcctagactctggac

SEQ ID NO: 1369 - DNA, 16 bp, Artificial sequence
  Synthetic oligonucleotide
ttgcctagactctgga

SEQ ID NO: 1370 - DNA, 16 bp, Artificial sequence
  Synthetic oligonucleotide
attgcctagactctgg

SEQ ID NO: 1371 - DNA, 16 bp, Artificial sequence
  Synthetic oligonucleotide
tttgacttgaactcag

SEQ ID NO: 1372 - DNA, 16 bp, Artificial sequence
  Synthetic oligonucleotide
atttgacttgaactca

SEQ ID NO: 1373 - DNA, 16 bp, Artificial sequence
  Synthetic oligonucleotide
aatttgacttgaactc

SEQ ID NO: 1374 - DNA, 16 bp, Artificial sequence
  Synthetic oligonucleotide
gaatttgacttgaact

SEQ ID NO: 1375 - DNA, 16 bp, Artificial sequence
  Synthetic oligonucleotide
agaatttgacttgaac

SEQ ID NO: 1376 - DNA, 16 bp, Artificial sequence
  Synthetic oligonucleotide
cagaatttgacttgaa

SEQ ID NO: 1377 - DNA, 16 bp, Artificial sequence
  Synthetic oligonucleotide
tcagaatttgacttga

SEQ ID NO: 1378 - DNA, 16 bp, Artificial sequence
  Synthetic oligonucleotide
ggctcagaatttgact

SEQ ID NO: 1379 - DNA, 16 bp, Artificial sequence
  Synthetic oligonucleotide
aggctcagaatttgac

SEQ ID NO: 1380 - DNA, 16 bp, Artificial sequence
  Synthetic oligonucleotide
ccccaggctcagaatt

SEQ ID NO: 1381 - DNA, 16 bp, Artificial sequence
  Synthetic oligonucleotide
agatgaggacccccca

SEQ ID NO: 1382 - DNA, 16 bp, Artificial sequence
  Synthetic oligonucleotide
cagatgaggacccccc

SEQ ID NO: 1383 - DNA, 16 bp, Artificial sequence
  Synthetic oligonucleotide
gcagatgaggaccccc

SEQ ID NO: 1384 - DNA, 16 bp, Artificial sequence
  Synthetic oligonucleotide
actctccatgctttgc

SEQ ID NO: 1385 - DNA, 16 bp, Artificial sequence
  Synthetic oligonucleotide
cactctccatgctttg

SEQ ID NO: 1386 - DNA, 16 bp, Artificial sequence
  Synthetic oligonucleotide
atgccactctccatgc

SEQ ID NO: 1387 - DNA, 16 bp, Artificial sequence
  Synthetic oligonucleotide
atgcaaagaagatgcc

SEQ ID NO: 1388 - DNA, 16 bp, Artificial sequence
  Synthetic oligonucleotide
gtccttaggatgcaaa

SEQ ID NO: 1389 - DNA, 16 bp, Artificial sequence
  Synthetic oligonucleotide
cgtccttaggatgcaa

SEQ ID NO: 1390 - DNA, 16 bp, Artificial sequence
  Synthetic oligonucleotide
gcagctctgagtgcac

SEQ ID NO: 1391 - DNA, 16 bp, Artificial sequence
  Synthetic oligonucleotide
gacattgtcctcagca

SEQ ID NO: 1392 - DNA, 16 bp, Artificial sequence
  Synthetic oligonucleotide
cagacattgtcctcag

SEQ ID NO: 1393 - DNA, 16 bp, Artificial sequence
  Synthetic oligonucleotide
cacttatttgatgacc

SEQ ID NO: 1394 - DNA, 16 bp, Artificial sequence
  Synthetic oligonucleotide
gcacttatttgatgac

SEQ ID NO: 1395 - DNA, 16 bp, Artificial sequence
  Synthetic oligonucleotide
cgatggcaagcactta

SEQ ID NO: 1396 - DNA, 16 bp, Artificial sequence
  Synthetic oligonucleotide
tcgatggcaagcactt

SEQ ID NO: 1397 - DNA, 16 bp, Artificial sequence
  Synthetic oligonucleotide
ctcgatggcaagcact

SEQ ID NO: 1398 - DNA, 16 bp, Artificial sequence
  Synthetic oligonucleotide
atgtctcgatggcaag

SEQ ID NO: 1399 - DNA, 16 bp, Artificial sequence
  Synthetic oligonucleotide
aatgtctcgatggcaa

SEQ ID NO: 1400 - DNA, 16 bp, Artificial sequence
  Synthetic oligonucleotide
aaatgtctcgatggca

SEQ ID NO: 1401 - DNA, 16 bp, Artificial sequence
  Synthetic oligonucleotide
taaatgtctcgatggc

SEQ ID NO: 1402 - DNA, 16 bp, Artificial sequence
  Synthetic oligonucleotide
ataaatgtctcgatgg

SEQ ID NO: 1403 - DNA, 16 bp, Artificial sequence
  Synthetic oligonucleotide
tataaatgtctcgatg

SEQ ID NO: 1404 - DNA, 16 bp, Artificial sequence
  Synthetic oligonucleotide
atcaactcctttataa

SEQ ID NO: 1405 - DNA, 16 bp, Artificial sequence
  Synthetic oligonucleotide
tatcaactcctttata

SEQ ID NO: 1406 - DNA, 16 bp, Artificial sequence
  Synthetic oligonucleotide
catatcaactccttta

SEQ ID NO: 1407 - DNA, 16 bp, Artificial sequence
  Synthetic oligonucleotide
ctctcatatcaactcc

SEQ ID NO: 1408 - DNA, 16 bp, Artificial sequence
  Synthetic oligonucleotide
cctctcatatcaactc

SEQ ID NO: 1409 - DNA, 16 bp, Artificial sequence
  Synthetic oligonucleotide
tcctctcatatcaact

SEQ ID NO: 1410 - DNA, 16 bp, Artificial sequence
  Synthetic oligonucleotide
actcctctcatatcaa

SEQ ID NO: 1411 - DNA, 16 bp, Artificial sequence
  Synthetic oligonucleotide
gactcctctcatatca

SEQ ID NO: 1412 - DNA, 16 bp, Artificial sequence
  Synthetic oligonucleotide
tgactcctctcatatc

SEQ ID NO: 1413 - DNA, 16 bp, Artificial sequence
  Synthetic oligonucleotide
ttgactcctctcatat

SEQ ID NO: 1414 - DNA, 16 bp, Artificial sequence
  Synthetic oligonucleotide
aaaattgactcctctc

SEQ ID NO: 1415 - DNA, 16 bp, Artificial sequence
  Synthetic oligonucleotide
ttaaaattgactcctc

SEQ ID NO: 1416 - DNA, 16 bp, Artificial sequence
  Synthetic oligonucleotide
ccttagacacattaaa

SEQ ID NO: 1417 - DNA, 16 bp, Artificial sequence
  Synthetic oligonucleotide
accttagacacattaa

SEQ ID NO: 1418 - DNA, 16 bp, Artificial sequence
  Synthetic oligonucleotide
aaccttagacacatta

SEQ ID NO: 1419 - DNA, 16 bp, Artificial sequence
  Synthetic oligonucleotide
ctaaccttagacacat

SEQ ID NO: 1420 - DNA, 16 bp, Artificial sequence
  Synthetic oligonucleotide
gctaaccttagacaca

SEQ ID NO: 1421 - DNA, 16 bp, Artificial sequence
  Synthetic oligonucleotide
tgctaaccttagacac

SEQ ID NO: 1422 - DNA, 16 bp, Artificial sequence
  Synthetic oligonucleotide
ctgctaaccttagaca

SEQ ID NO: 1423 - DNA, 16 bp, Artificial sequence
  Synthetic oligonucleotide
actgctaaccttagac

SEQ ID NO: 1424 - DNA, 16 bp, Artificial sequence
  Synthetic oligonucleotide
cactgctaaccttaga

SEQ ID NO: 1425 - DNA, 16 bp, Artificial sequence
  Synthetic oligonucleotide
acactgctaaccttag

SEQ ID NO: 1426 - DNA, 16 bp, Artificial sequence
  Synthetic oligonucleotide
aacactgctaacctta

SEQ ID NO: 1427 - DNA, 16 bp, Artificial sequence
  Synthetic oligonucleotide
tcaacactgctaacct

SEQ ID NO: 1428 - DNA, 16 bp, Artificial sequence
  Synthetic oligonucleotide
ttcaacactgctaacc

SEQ ID NO: 1429 - DNA, 16 bp, Artificial sequence
  Synthetic oligonucleotide
attcttcaacactgct

SEQ ID NO: 1430 - DNA, 16 bp, Artificial sequence
  Synthetic oligonucleotide
ctggcagcgaatgtta

SEQ ID NO: 1431 - DNA, 16 bp, Artificial sequence
  Synthetic oligonucleotide
actggcagcgaatgtt

SEQ ID NO: 1432 - DNA, 16 bp, Artificial sequence
  Synthetic oligonucleotide
cgtggcatatgaaaaa

SEQ ID NO: 1433 - DNA, 16 bp, Artificial sequence
  Synthetic oligonucleotide
ctctgccttgtgaaat

SEQ ID NO: 1434 - DNA, 16 bp, Artificial sequence
  Synthetic oligonucleotide
cggtactctgccttgt

SEQ ID NO: 1435 - DNA, 16 bp, Artificial sequence
  Synthetic oligonucleotide
ttccggtactctgcct

SEQ ID NO: 1436 - DNA, 16 bp, Artificial sequence
  Synthetic oligonucleotide
ttgttccggtactctg

SEQ ID NO: 1437 - DNA, 16 bp, Artificial sequence
  Synthetic oligonucleotide
attgttccggtactct

SEQ ID NO: 1438 - DNA, 16 bp, Artificial sequence
  Synthetic oligonucleotide
caattgttccggtact

SEQ ID NO: 1439 - DNA, 16 bp, Artificial sequence
  Synthetic oligonucleotide
gcaattgttccggtac

SEQ ID NO: 1440 - DNA, 16 bp, Artificial sequence
  Synthetic oligonucleotide
ggcaattgttccggta

SEQ ID NO: 1441 - DNA, 16 bp, Artificial sequence
  Synthetic oligonucleotide
ctttaataggcaattg

SEQ ID NO: 1442 - DNA, 16 bp, Artificial sequence
  Synthetic oligonucleotide
gtactttaataggcaa

SEQ ID NO: 1443 - DNA, 16 bp, Artificial sequence
  Synthetic oligonucleotide
tgtactttaataggca

SEQ ID NO: 1444 - DNA, 16 bp, Artificial sequence
  Synthetic oligonucleotide
ctgtactttaataggc

SEQ ID NO: 1445 - DNA, 16 bp, Artificial sequence
  Synthetic oligonucleotide
actgtactttaatagg

SEQ ID NO: 1446 - DNA, 16 bp, Artificial sequence
  Synthetic oligonucleotide
ctcagcacctttatag

SEQ ID NO: 1447 - DNA, 16 bp, Artificial sequence
  Synthetic oligonucleotide
actcagcacctttata

SEQ ID NO: 1448 - DNA, 16 bp, Artificial sequence
  Synthetic oligonucleotide
tactcagcacctttat

SEQ ID NO: 1449 - DNA, 16 bp, Artificial sequence
  Synthetic oligonucleotide
ttactcagcaccttta

SEQ ID NO: 1450 - DNA, 16 bp, Artificial sequence
  Synthetic oligonucleotide
atttctgaaagggcac

SEQ ID NO: 1451 - DNA, 16 bp, Artificial sequence
  Synthetic oligonucleotide
caatttctgaaagggc

SEQ ID NO: 1452 - DNA, 16 bp, Artificial sequence
  Synthetic oligonucleotide
ccaatttctgaaaggg

SEQ ID NO: 1453 - DNA, 16 bp, Artificial sequence
  Synthetic oligonucleotide
accaatttctgaaagg

SEQ ID NO: 1454 - DNA, 16 bp, Artificial sequence
  Synthetic oligonucleotide
tggcaaccaatttctg

SEQ ID NO: 1455 - DNA, 16 bp, Artificial sequence
  Synthetic oligonucleotide
atccacatctgagaac

SEQ ID NO: 1456 - DNA, 16 bp, Artificial sequence
  Synthetic oligonucleotide
gcaacatccacatctg

SEQ ID NO: 1457 - DNA, 16 bp, Artificial sequence
  Synthetic oligonucleotide
ggcaacatccacatct

SEQ ID NO: 1458 - DNA, 16 bp, Artificial sequence
  Synthetic oligonucleotide
tggcaacatccacatc

SEQ ID NO: 1459 - DNA, 16 bp, Artificial sequence
  Synthetic oligonucleotide
cctggcaacatccaca

SEQ ID NO: 1460 - DNA, 16 bp, Artificial sequence
  Synthetic oligonucleotide
accctggcaacatcca

SEQ ID NO: 1461 - DNA, 16 bp, Artificial sequence
  Synthetic oligonucleotide
aaccctggcaacatcc

SEQ ID NO: 1462 - DNA, 16 bp, Artificial sequence
  Synthetic oligonucleotide
gaaccctggcaacatc

SEQ ID NO: 1463 - DNA, 16 bp, Artificial sequence
  Synthetic oligonucleotide
tgaacggtcttcaagc

SEQ ID NO: 1464 - DNA, 16 bp, Artificial sequence
  Synthetic oligonucleotide
atgaacggtcttcaag

SEQ ID NO: 1465 - DNA, 16 bp, Artificial sequence
  Synthetic oligonucleotide
taaaaatgaacggtct

SEQ ID NO: 1466 - DNA, 16 bp, Artificial sequence
  Synthetic oligonucleotide
gagtctcttgtcactt

SEQ ID NO: 1467 - DNA, 16 bp, Artificial sequence
  Synthetic oligonucleotide
tgagtctcttgtcact

SEQ ID NO: 1468 - DNA, 16 bp, Artificial sequence
  Synthetic oligonucleotide
ggtgagtctcttgtca

SEQ ID NO: 1469 - DNA, 16 bp, Artificial sequence
  Synthetic oligonucleotide
aggtgagtctcttgtc

SEQ ID NO: 1470 - DNA, 16 bp, Artificial sequence
  Synthetic oligonucleotide
tggaggtgagtctctt

SEQ ID NO: 1471 - DNA, 16 bp, Artificial sequence
  Synthetic oligonucleotide
ttggaggtgagtctct

SEQ ID NO: 1472 - DNA, 16 bp, Artificial sequence
  Synthetic oligonucleotide
cttggaggtgagtctc

SEQ ID NO: 1473 - DNA, 16 bp, Artificial sequence
  Synthetic oligonucleotide
tcttggaggtgagtct

SEQ ID NO: 1474 - DNA, 16 bp, Artificial sequence
  Synthetic oligonucleotide
ttgcttcttggaggtg

SEQ ID NO: 1475 - DNA, 16 bp, Artificial sequence
  Synthetic oligonucleotide
attgcttcttggaggt

SEQ ID NO: 1476 - DNA, 16 bp, Artificial sequence
  Synthetic oligonucleotide
caattgcttcttggag

SEQ ID NO: 1477 - DNA, 16 bp, Artificial sequence
  Synthetic oligonucleotide
cacaattgcttcttgg

SEQ ID NO: 1478 - DNA, 16 bp, Artificial sequence
  Synthetic oligonucleotide
gcttgaataaaatcat

SEQ ID NO: 1479 - DNA, 16 bp, Artificial sequence
  Synthetic oligonucleotide
gttgcttgcttgaata

SEQ ID NO: 1480 - DNA, 16 bp, Artificial sequence
  Synthetic oligonucleotide
agttgcttgcttgaat

SEQ ID NO: 1481 - DNA, 16 bp, Artificial sequence
  Synthetic oligonucleotide
aagttgcttgcttgaa

SEQ ID NO: 1482 - DNA, 16 bp, Artificial sequence
  Synthetic oligonucleotide
taagttgcttgcttga

SEQ ID NO: 1483 - DNA, 16 bp, Artificial sequence
  Synthetic oligonucleotide
gaaataagttgcttgc

SEQ ID NO: 1484 - DNA, 16 bp, Artificial sequence
  Synthetic oligonucleotide
tgaaataagttgcttg

SEQ ID NO: 1485 - DNA, 16 bp, Artificial sequence
  Synthetic oligonucleotide
actgtagcaaacaagg

SEQ ID NO: 1486 - DNA, 16 bp, Artificial sequence
  Synthetic oligonucleotide
tccacaggaaactgta

SEQ ID NO: 1487 - DNA, 16 bp, Artificial sequence
  Synthetic oligonucleotide
atccacaggaaactgt

SEQ ID NO: 1488 - DNA, 16 bp, Artificial sequence
  Synthetic oligonucleotide
tcatagagttgagtca

SEQ ID NO: 1489 - DNA, 16 bp, Artificial sequence
  Synthetic oligonucleotide
acctctgaagaaggcg

SEQ ID NO: 1490 - DNA, 16 bp, Artificial sequence
  Synthetic oligonucleotide
atccccacctctgaag

SEQ ID NO: 1491 - DNA, 16 bp, Artificial sequence
  Synthetic oligonucleotide
agctacatccccacct

SEQ ID NO: 1492 - DNA, 16 bp, Artificial sequence
  Synthetic oligonucleotide
gaagctacatccccac

SEQ ID NO: 1493 - DNA, 16 bp, Artificial sequence
  Synthetic oligonucleotide
acatggaagctacatc

SEQ ID NO: 1494 - DNA, 16 bp, Artificial sequence
  Synthetic oligonucleotide
tacatggaagctacat

SEQ ID NO: 1495 - DNA, 16 bp, Artificial sequence
  Synthetic oligonucleotide
gtacatggaagctaca

SEQ ID NO: 1496 - DNA, 16 bp, Artificial sequence
  Synthetic oligonucleotide
tgtacatggaagctac

SEQ ID NO: 1497 - DNA, 16 bp, Artificial sequence
  Synthetic oligonucleotide
gtgtacatggaagcta

SEQ ID NO: 1498 - DNA, 16 bp, Artificial sequence
  Synthetic oligonucleotide
gggtgtacatggaagc

SEQ ID NO: 1499 - DNA, 16 bp, Artificial sequence
  Synthetic oligonucleotide
gcagtattgggcattt

SEQ ID NO: 1500 - DNA, 16 bp, Artificial sequence
  Synthetic oligonucleotide
catctggcagtattgg

SEQ ID NO: 1501 - DNA, 16 bp, Artificial sequence
  Synthetic oligonucleotide
tcatctggcagtattg

SEQ ID NO: 1502 - DNA, 16 bp, Artificial sequence
  Synthetic oligonucleotide
cctcatctggcagtat

SEQ ID NO: 1503 - DNA, 16 bp, Artificial sequence
  Synthetic oligonucleotide
acctcatctggcagta

SEQ ID NO: 1504 - DNA, 16 bp, Artificial sequence
  Synthetic oligonucleotide
gtgcacctcatctggc

SEQ ID NO: 1505 - DNA, 16 bp, Artificial sequence
  Synthetic oligonucleotide
ggtggaatgtgcacct

SEQ ID NO: 1506 - DNA, 16 bp, Artificial sequence
  Synthetic oligonucleotide
gggtggaatgtgcacc

SEQ ID NO: 1507 - DNA, 16 bp, Artificial sequence
  Synthetic oligonucleotide
aacttgctggaagaaa

SEQ ID NO: 1508 - DNA, 16 bp, Artificial sequence
  Synthetic oligonucleotide
gaacttgctggaagaa

SEQ ID NO: 1509 - DNA, 16 bp, Artificial sequence
  Synthetic oligonucleotide
tgaacttgctggaaga

SEQ ID NO: 1510 - DNA, 16 bp, Artificial sequence
  Synthetic oligonucleotide
gattgaacttgctgga

SEQ ID NO: 1511 - DNA, 16 bp, Artificial sequence
  Synthetic oligonucleotide
cattgattgaacttgc

SEQ ID NO: 1512 - DNA, 16 bp, Artificial sequence
  Synthetic oligonucleotide
tcattgattgaacttg

SEQ ID NO: 1513 - DNA, 16 bp, Artificial sequence
  Synthetic oligonucleotide
caaaccttttctccat

SEQ ID NO: 1514 - DNA, 16 bp, Artificial sequence
  Synthetic oligonucleotide
gcaaccaaaccttttc

SEQ ID NO: 1515 - DNA, 16 bp, Artificial sequence
  Synthetic oligonucleotide
agcaaccaaacctttt

SEQ ID NO: 1516 - DNA, 16 bp, Artificial sequence
  Synthetic oligonucleotide
cgatgtacttttggca

SEQ ID NO: 1517 - DNA, 16 bp, Artificial sequence
  Synthetic oligonucleotide
tcgatgtacttttggc

SEQ ID NO: 1518 - DNA, 16 bp, Artificial sequence
  Synthetic oligonucleotide
ttcgatgtacttttgg

SEQ ID NO: 1519 - DNA, 16 bp, Artificial sequence
  Synthetic oligonucleotide
gttcgatgtacttttg

SEQ ID NO: 1520 - DNA, 16 bp, Artificial sequence
  Synthetic oligonucleotide
cctgttcgatgtactt

SEQ ID NO: 1521 - DNA, 16 bp, Artificial sequence
  Synthetic oligonucleotide
acctgttcgatgtact

SEQ ID NO: 1522 - DNA, 16 bp, Artificial sequence
  Synthetic oligonucleotide
gcacctgttcgatgta

SEQ ID NO: 1523 - DNA, 16 bp, Artificial sequence
  Synthetic oligonucleotide
ctgcacctgttcgatg

SEQ ID NO: 1524 - DNA, 16 bp, Artificial sequence
  Synthetic oligonucleotide
actgcacctgttcgat

SEQ ID NO: 1525 - DNA, 16 bp, Artificial sequence
  Synthetic oligonucleotide
aactgcacctgttcga

SEQ ID NO: 1526 - DNA, 16 bp, Artificial sequence
  Synthetic oligonucleotide
aaactgcacctgttcg

SEQ ID NO: 1527 - DNA, 16 bp, Artificial sequence
  Synthetic oligonucleotide
ccagaaactgcacctg

SEQ ID NO: 1528 - DNA, 16 bp, Artificial sequence
  Synthetic oligonucleotide
tccagaaactgcacct

SEQ ID NO: 1529 - DNA, 16 bp, Artificial sequence
  Synthetic oligonucleotide
tgtccagaaactgcac

SEQ ID NO: 1530 - DNA, 16 bp, Artificial sequence
  Synthetic oligonucleotide
cttcaaggaatgtcca

SEQ ID NO: 1531 - DNA, 16 bp, Artificial sequence
  Synthetic oligonucleotide
gcttcaaggaatgtcc

SEQ ID NO: 1532 - DNA, 16 bp, Artificial sequence
  Synthetic oligonucleotide
ttgcttcaaggaatgt

SEQ ID NO: 1533 - DNA, 16 bp, Artificial sequence
  Synthetic oligonucleotide
cacattgcttcaagga

SEQ ID NO: 1534 - DNA, 16 bp, Artificial sequence
  Synthetic oligonucleotide
gatgaccacattgctt

SEQ ID NO: 1535 - DNA, 16 bp, Artificial sequence
  Synthetic oligonucleotide
ctcatatcaactcctt

SEQ ID NO: 1536 - DNA, 16 bp, Artificial sequence
  Synthetic oligonucleotide
caacactgctaacctt

SEQ ID NO: 1537 - DNA, 16 bp, Artificial sequence
  Synthetic oligonucleotide
ccggtactctgccttg

SEQ ID NO: 1538 - DNA, 16 bp, Artificial sequence
  Synthetic oligonucleotide
tccggtactctgcctt

SEQ ID NO: 1539 - DNA, 16 bp, Artificial sequence
  Synthetic oligonucleotide
aggcaattgttccggt

SEQ ID NO: 1540 - DNA, 16 bp, Artificial sequence
  Synthetic oligonucleotide
taggcaattgttccgg

SEQ ID NO: 1541 - DNA, 16 bp, Artificial sequence
  Synthetic oligonucleotide
ataggcaattgttccg

SEQ ID NO: 1542 - DNA, 16 bp, Artificial sequence
  Synthetic oligonucleotide
gagaaccctggcaaca

SEQ ID NO: 1543 - DNA, 16 bp, Artificial sequence
  Synthetic oligonucleotide
tgagaaccctggcaac

SEQ ID NO: 1544 - DNA, 16 bp, Artificial sequence
  Synthetic oligonucleotide
tggagtgagaaccctg

SEQ ID NO: 1545 - DNA, 16 bp, Artificial sequence
  Synthetic oligonucleotide
atctggagtgagaacc

SEQ ID NO: 1546 - DNA, 16 bp, Artificial sequence
  Synthetic oligonucleotide
gtccgacacacaaaag

SEQ ID NO: 1547 - DNA, 16 bp, Artificial sequence
  Synthetic oligonucleotide
ggtccgacacacaaaa

SEQ ID NO: 1548 - DNA, 16 bp, Artificial sequence
  Synthetic oligonucleotide
atggtccgacacacaa

SEQ ID NO: 1549 - DNA, 16 bp, Artificial sequence
  Synthetic oligonucleotide
gatggtccgacacaca

SEQ ID NO: 1550 - DNA, 16 bp, Artificial sequence
  Synthetic oligonucleotide
agatggtccgacacac

SEQ ID NO: 1551 - DNA, 16 bp, Artificial sequence
  Synthetic oligonucleotide
tgataggtgcagatgg

SEQ ID NO: 1552 - DNA, 16 bp, Artificial sequence
  Synthetic oligonucleotide
gtgataggtgcagatg

SEQ ID NO: 1553 - DNA, 16 bp, Artificial sequence
  Synthetic oligonucleotide
cgattttccatacatt

SEQ ID NO: 1554 - DNA, 16 bp, Artificial sequence
  Synthetic oligonucleotide
tcgattttccatacat

SEQ ID NO: 1555 - DNA, 16 bp, Artificial sequence
  Synthetic oligonucleotide
ctcgattttccataca

SEQ ID NO: 1556 - DNA, 16 bp, Artificial sequence
  Synthetic oligonucleotide
actcgattttccatac

SEQ ID NO: 1557 - DNA, 16 bp, Artificial sequence
  Synthetic oligonucleotide
gactcgattttccata

SEQ ID NO: 1558 - DNA, 16 bp, Artificial sequence
  Synthetic oligonucleotide
tgtgactcgattttcc

SEQ ID NO: 1559 - DNA, 16 bp, Artificial sequence
  Synthetic oligonucleotide
ttgtgactcgattttc

SEQ ID NO: 1560 - DNA, 16 bp, Artificial sequence
  Synthetic oligonucleotide
tttgtgactcgatttt

SEQ ID NO: 1561 - DNA, 16 bp, Artificial sequence
  Synthetic oligonucleotide
tttctttgtgactcga

SEQ ID NO: 1562 - DNA, 16 bp, Artificial sequence
  Synthetic oligonucleotide
gtgtgccactttcaga

SEQ ID NO: 1563 - DNA, 16 bp, Artificial sequence
  Synthetic oligonucleotide
ggtgtgccactttcag

SEQ ID NO: 1564 - DNA, 16 bp, Artificial sequence
  Synthetic oligonucleotide
tggtgtgccactttca

SEQ ID NO: 1565 - DNA, 16 bp, Artificial sequence
  Synthetic oligonucleotide
acttggtgtgccactt

SEQ ID NO: 1566 - DNA, 16 bp, Artificial sequence
  Synthetic oligonucleotide
aacttggtgtgccact

SEQ ID NO: 1567 - DNA, 16 bp, Artificial sequence
  Synthetic oligonucleotide
gaacttggtgtgccac

SEQ ID NO: 1568 - DNA, 16 bp, Artificial sequence
  Synthetic oligonucleotide
ggaacttggtgtgcca

SEQ ID NO: 1569 - DNA, 16 bp, Artificial sequence
  Synthetic oligonucleotide
aggaacttggtgtgcc

SEQ ID NO: 1570 - DNA, 16 bp, Artificial sequence
  Synthetic oligonucleotide
gtgttttcttgaggag

SEQ ID NO: 1571 - DNA, 16 bp, Artificial sequence
  Synthetic oligonucleotide
ggtgttttcttgagga

SEQ ID NO: 1572 - DNA, 16 bp, Artificial sequence
  Synthetic oligonucleotide
agatatggtgttttct

SEQ ID NO: 1573 - DNA, 16 bp, Artificial sequence
  Synthetic oligonucleotide
cagatatggtgttttc

SEQ ID NO: 1574 - DNA, 16 bp, Artificial sequence
  Synthetic oligonucleotide
ctatatccagatatgg

SEQ ID NO: 1575 - DNA, 16 bp, Artificial sequence
  Synthetic oligonucleotide
taaaaggctatatcca

SEQ ID NO: 1576 - DNA, 16 bp, Artificial sequence
  Synthetic oligonucleotide
gttaaaaggctatatc

SEQ ID NO: 1577 - DNA, 16 bp, Artificial sequence
  Synthetic oligonucleotide
ggttaaaaggctatat

SEQ ID NO: 1578 - DNA, 16 bp, Artificial sequence
  Synthetic oligonucleotide
caggttaaaaggctat

SEQ ID NO: 1579 - DNA, 16 bp, Artificial sequence
  Synthetic oligonucleotide
gcaggttaaaaggcta

SEQ ID NO: 1580 - DNA, 16 bp, Artificial sequence
  Synthetic oligonucleotide
tgcaggttaaaaggct

SEQ ID NO: 1581 - DNA, 16 bp, Artificial sequence
  Synthetic oligonucleotide
ttgcaggttaaaaggc

SEQ ID NO: 1582 - DNA, 16 bp, Artificial sequence
  Synthetic oligonucleotide
tttgcaggttaaaagg

SEQ ID NO: 1583 - DNA, 16 bp, Artificial sequence
  Synthetic oligonucleotide
gttcaggtaaagttct

SEQ ID NO: 1584 - DNA, 16 bp, Artificial sequence
  Synthetic oligonucleotide
ggttcaggtaaagttc

SEQ ID NO: 1585 - DNA, 16 bp, Artificial sequence
  Synthetic oligonucleotide
gggttcaggtaaagtt

SEQ ID NO: 1586 - DNA, 16 bp, Artificial sequence
  Synthetic oligonucleotide
agggttcaggtaaagt

SEQ ID NO: 1587 - DNA, 16 bp, Artificial sequence
  Synthetic oligonucleotide
ggcagggttcaggtaa

SEQ ID NO: 1588 - DNA, 16 bp, Artificial sequence
  Synthetic oligonucleotide
ttagaatggcagggtt

SEQ ID NO: 1589 - DNA, 16 bp, Artificial sequence
  Synthetic oligonucleotide
tcccgggtaaatttta

SEQ ID NO: 1590 - DNA, 16 bp, Artificial sequence
  Synthetic oligonucleotide
ctcccgggtaaatttt

SEQ ID NO: 1591 - DNA, 16 bp, Artificial sequence
  Synthetic oligonucleotide
tcaactcccgggtaaa

SEQ ID NO: 1592 - DNA, 16 bp, Artificial sequence
  Synthetic oligonucleotide
aagtcaactcccgggt

SEQ ID NO: 1593 - DNA, 16 bp, Artificial sequence
  Synthetic oligonucleotide
aaagtcaactcccggg

SEQ ID NO: 1594 - DNA, 16 bp, Artificial sequence
  Synthetic oligonucleotide
caaagtcaactcccgg

SEQ ID NO: 1595 - DNA, 16 bp, Artificial sequence
  Synthetic oligonucleotide
ccaaagtcaactcccg

SEQ ID NO: 1596 - DNA, 16 bp, Artificial sequence
  Synthetic oligonucleotide
cctccaaagtcaactc

SEQ ID NO: 1597 - DNA, 16 bp, Artificial sequence
  Synthetic oligonucleotide
cttggcaaacattcac

SEQ ID NO: 1598 - DNA, 16 bp, Artificial sequence
  Synthetic oligonucleotide
gtctcttggcaaacat

SEQ ID NO: 1599 - DNA, 16 bp, Artificial sequence
  Synthetic oligonucleotide
aagtctcttggcaaac

SEQ ID NO: 1600 - DNA, 16 bp, Artificial sequence
  Synthetic oligonucleotide
tctttgtgcaagtctc

SEQ ID NO: 1601 - DNA, 16 bp, Artificial sequence
  Synthetic oligonucleotide
aatcatctttgtgcaa

SEQ ID NO: 1602 - DNA, 16 bp, Artificial sequence
  Synthetic oligonucleotide
gaatcatctttgtgca

SEQ ID NO: 1603 - DNA, 16 bp, Artificial sequence
  Synthetic oligonucleotide
cgaatcatctttgtgc

SEQ ID NO: 1604 - DNA, 16 bp, Artificial sequence
  Synthetic oligonucleotide
gcgaatcatctttgtg

SEQ ID NO: 1605 - DNA, 16 bp, Artificial sequence
  Synthetic oligonucleotide
cagcgaatcatctttg

SEQ ID NO: 1606 - DNA, 16 bp, Artificial sequence
  Synthetic oligonucleotide
acagcgaatcatcttt

SEQ ID NO: 1607 - DNA, 16 bp, Artificial sequence
  Synthetic oligonucleotide
tgacagcgaatcatct

SEQ ID NO: 1608 - DNA, 16 bp, Artificial sequence
  Synthetic oligonucleotide
ctgacagcgaatcatc

SEQ ID NO: 1609 - DNA, 16 bp, Artificial sequence
  Synthetic oligonucleotide
actgacagcgaatcat

SEQ ID NO: 1610 - DNA, 16 bp, Artificial sequence
  Synthetic oligonucleotide
tacagtcttctgggag

SEQ ID NO: 1611 - DNA, 16 bp, Artificial sequence
  Synthetic oligonucleotide
ccttacagtcttctgg

SEQ ID NO: 1612 - DNA, 16 bp, Artificial sequence
  Synthetic oligonucleotide
tagataatcttaagaa

SEQ ID NO: 1613 - DNA, 16 bp, Artificial sequence
  Synthetic oligonucleotide
ccatccatagataatc

SEQ ID NO: 1614 - DNA, 16 bp, Artificial sequence
  Synthetic oligonucleotide
gtgtcccatacgcaat

SEQ ID NO: 1615 - DNA, 16 bp, Artificial sequence
  Synthetic oligonucleotide
tgtgtcccatacgcaa

SEQ ID NO: 1616 - DNA, 16 bp, Artificial sequence
  Synthetic oligonucleotide
ttgtgtcccatacgca

SEQ ID NO: 1617 - DNA, 16 bp, Artificial sequence
  Synthetic oligonucleotide
cttgtgtcccatacgc

SEQ ID NO: 1618 - DNA, 16 bp, Artificial sequence
  Synthetic oligonucleotide
ccttgtgtcccatacg

SEQ ID NO: 1619 - DNA, 16 bp, Artificial sequence
  Synthetic oligonucleotide
cccttgtgtcccatac

SEQ ID NO: 1620 - DNA, 16 bp, Artificial sequence
  Synthetic oligonucleotide
accagagctcccttgt

SEQ ID NO: 1621 - DNA, 16 bp, Artificial sequence
  Synthetic oligonucleotide
aaccagagctcccttg

SEQ ID NO: 1622 - DNA, 16 bp, Artificial sequence
  Synthetic oligonucleotide
taaccagagctccctt

SEQ ID NO: 1623 - DNA, 16 bp, Artificial sequence
  Synthetic oligonucleotide
agtaaccagagctccc

SEQ ID NO: 1624 - DNA, 16 bp, Artificial sequence
  Synthetic oligonucleotide
agagtaaccagagctc

SEQ ID NO: 1625 - DNA, 16 bp, Artificial sequence
  Synthetic oligonucleotide
caaagagtaaccagag

SEQ ID NO: 1626 - DNA, 16 bp, Artificial sequence
  Synthetic oligonucleotide
ctcaaagagtaaccag

SEQ ID NO: 1627 - DNA, 16 bp, Artificial sequence
  Synthetic oligonucleotide
tctcaaagagtaacca

SEQ ID NO: 1628 - DNA, 16 bp, Artificial sequence
  Synthetic oligonucleotide
gttacacaatctcaaa

SEQ ID NO: 1629 - DNA, 16 bp, Artificial sequence
  Synthetic oligonucleotide
agtgttacacaatctc

SEQ ID NO: 1630 - DNA, 16 bp, Artificial sequence
  Synthetic oligonucleotide
ccagtgttacacaatc

SEQ ID NO: 1631 - DNA, 16 bp, Artificial sequence
  Synthetic oligonucleotide
tccccagtgttacaca

SEQ ID NO: 1632 - DNA, 16 bp, Artificial sequence
  Synthetic oligonucleotide
gtccccagtgttacac

SEQ ID NO: 1633 - DNA, 16 bp, Artificial sequence
  Synthetic oligonucleotide
tgtccccagtgttaca

SEQ ID NO: 1634 - DNA, 16 bp, Artificial sequence
  Synthetic oligonucleotide
ttgtccccagtgttac

SEQ ID NO: 1635 - DNA, 16 bp, Artificial sequence
  Synthetic oligonucleotide
aagagtttgttcctcc

SEQ ID NO: 1636 - DNA, 16 bp, Artificial sequence
  Synthetic oligonucleotide
caagaagagtttgttc

SEQ ID NO: 1637 - DNA, 16 bp, Artificial sequence
  Synthetic oligonucleotide
ccaagaagagtttgtt

SEQ ID NO: 1638 - DNA, 16 bp, Artificial sequence
  Synthetic oligonucleotide
ccccaagaagagtttg

SEQ ID NO: 1639 - DNA, 16 bp, Artificial sequence
  Synthetic oligonucleotide
tccccaagaagagttt

SEQ ID NO: 1640 - DNA, 16 bp, Artificial sequence
  Synthetic oligonucleotide
cactctccccaagaag

SEQ ID NO: 1641 - DNA, 16 bp, Artificial sequence
  Synthetic oligonucleotide
ccactctccccaagaa

SEQ ID NO: 1642 - DNA, 16 bp, Artificial sequence
  Synthetic oligonucleotide
gcttcacctgcaggct

SEQ ID NO: 1643 - DNA, 16 bp, Artificial sequence
  Synthetic oligonucleotide
gctgtcagcttcacct

SEQ ID NO: 1644 - DNA, 16 bp, Artificial sequence
  Synthetic oligonucleotide
tgagctgtcagcttca

SEQ ID NO: 1645 - DNA, 16 bp, Artificial sequence
  Synthetic oligonucleotide
gtcctatgagtgaccc

SEQ ID NO: 1646 - DNA, 16 bp, Artificial sequence
  Synthetic oligonucleotide
gtgtcctatgagtgac

SEQ ID NO: 1647 - DNA, 16 bp, Artificial sequence
  Synthetic oligonucleotide
ggtgtcctatgagtga

SEQ ID NO: 1648 - DNA, 16 bp, Artificial sequence
  Synthetic oligonucleotide
tggtgtcctatgagtg

SEQ ID NO: 1649 - DNA, 16 bp, Artificial sequence
  Synthetic oligonucleotide
ctggtgtcctatgagt

SEQ ID NO: 1650 - DNA, 16 bp, Artificial sequence
  Synthetic oligonucleotide
gatgcgccaaacatcc

SEQ ID NO: 1651 - DNA, 16 bp, Artificial sequence
  Synthetic oligonucleotide
agatgcgccaaacatc

SEQ ID NO: 1652 - DNA, 16 bp, Artificial sequence
  Synthetic oligonucleotide
atagatgcgccaaaca

SEQ ID NO: 1653 - DNA, 16 bp, Artificial sequence
  Synthetic oligonucleotide
cactatagatgcgcca

SEQ ID NO: 1654 - DNA, 16 bp, Artificial sequence
  Synthetic oligonucleotide
ccactatagatgcgcc

SEQ ID NO: 1655 - DNA, 16 bp, Artificial sequence
  Synthetic oligonucleotide
aatgtctgacagattt

SEQ ID NO: 1656 - DNA, 16 bp, Artificial sequence
  Synthetic oligonucleotide
taatgtctgacagatt

SEQ ID NO: 1657 - DNA, 16 bp, Artificial sequence
  Synthetic oligonucleotide
gaaaggtgtatctttt

SEQ ID NO: 1658 - DNA, 16 bp, Artificial sequence
  Synthetic oligonucleotide
gtgagaaaggtgtatc

SEQ ID NO: 1659 - DNA, 16 bp, Artificial sequence
  Synthetic oligonucleotide
tgtgagaaaggtgtat

SEQ ID NO: 1660 - DNA, 16 bp, Artificial sequence
  Synthetic oligonucleotide
tttgtgagaaaggtgt

SEQ ID NO: 1661 - DNA, 16 bp, Artificial sequence
  Synthetic oligonucleotide
atttgtgagaaaggtg

SEQ ID NO: 1662 - DNA, 16 bp, Artificial sequence
  Synthetic oligonucleotide
tggtgaataataatct

SEQ ID NO: 1663 - DNA, 16 bp, Artificial sequence
  Synthetic oligonucleotide
ttatagttttggtgaa

SEQ ID NO: 1664 - DNA, 16 bp, Artificial sequence
  Synthetic oligonucleotide
tatcatgattcccttc

SEQ ID NO: 1665 - DNA, 16 bp, Artificial sequence
  Synthetic oligonucleotide
gatatcatgattccct

SEQ ID NO: 1666 - DNA, 16 bp, Artificial sequence
  Synthetic oligonucleotide
cgatatcatgattccc

SEQ ID NO: 1667 - DNA, 16 bp, Artificial sequence
  Synthetic oligonucleotide
gcgatatcatgattcc

SEQ ID NO: 1668 - DNA, 16 bp, Artificial sequence
  Synthetic oligonucleotide
aggcgatatcatgatt

SEQ ID NO: 1669 - DNA, 16 bp, Artificial sequence
  Synthetic oligonucleotide
aaggcgatatcatgat

SEQ ID NO: 1670 - DNA, 16 bp, Artificial sequence
  Synthetic oligonucleotide
caaaggagcctggagt

SEQ ID NO: 1671 - DNA, 16 bp, Artificial sequence
  Synthetic oligonucleotide
attcaaaggagcctgg

SEQ ID NO: 1672 - DNA, 16 bp, Artificial sequence
  Synthetic oligonucleotide
aattcaaaggagcctg

SEQ ID NO: 1673 - DNA, 16 bp, Artificial sequence
  Synthetic oligonucleotide
gtaattcaaaggagcc

SEQ ID NO: 1674 - DNA, 16 bp, Artificial sequence
  Synthetic oligonucleotide
gtgtaattcaaaggag

SEQ ID NO: 1675 - DNA, 16 bp, Artificial sequence
  Synthetic oligonucleotide
catattggtttttgga

SEQ ID NO: 1676 - DNA, 16 bp, Artificial sequence
  Synthetic oligonucleotide
gcatattggtttttgg

SEQ ID NO: 1677 - DNA, 16 bp, Artificial sequence
  Synthetic oligonucleotide
taggcatattggtttt

SEQ ID NO: 1678 - DNA, 16 bp, Artificial sequence
  Synthetic oligonucleotide
cttgtgtcacctttgg

SEQ ID NO: 1679 - DNA, 16 bp, Artificial sequence
  Synthetic oligonucleotide
gcttgtgtcacctttg

SEQ ID NO: 1680 - DNA, 16 bp, Artificial sequence
  Synthetic oligonucleotide
ataaattgtgcttgtg

SEQ ID NO: 1681 - DNA, 16 bp, Artificial sequence
  Synthetic oligonucleotide
gtataaattgtgcttg

SEQ ID NO: 1682 - DNA, 16 bp, Artificial sequence
  Synthetic oligonucleotide
tggtataaattgtgct

SEQ ID NO: 1683 - DNA, 16 bp, Artificial sequence
  Synthetic oligonucleotide
ttggtataaattgtgc

SEQ ID NO: 1684 - DNA, 16 bp, Artificial sequence
  Synthetic oligonucleotide
cagttggtataaattg

SEQ ID NO: 1685 - DNA, 16 bp, Artificial sequence
  Synthetic oligonucleotide
caacagttggtataaa

SEQ ID NO: 1686 - DNA, 16 bp, Artificial sequence
  Synthetic oligonucleotide
ccaacagttggtataa

SEQ ID NO: 1687 - DNA, 16 bp, Artificial sequence
  Synthetic oligonucleotide
cccaacagttggtata

SEQ ID NO: 1688 - DNA, 16 bp, Artificial sequence
  Synthetic oligonucleotide
agaagccccatccggt

SEQ ID NO: 1689 - DNA, 16 bp, Artificial sequence
  Synthetic oligonucleotide
tttctccttcgagaag

SEQ ID NO: 1690 - DNA, 16 bp, Artificial sequence
  Synthetic oligonucleotide
ctttctccttcgagaa

SEQ ID NO: 1691 - DNA, 16 bp, Artificial sequence
  Synthetic oligonucleotide
gggcttcagccagaca

SEQ ID NO: 1692 - DNA, 16 bp, Artificial sequence
  Synthetic oligonucleotide
cgggcttcagccagac

SEQ ID NO: 1693 - DNA, 16 bp, Artificial sequence
  Synthetic oligonucleotide
tgctgaaagcgggctt

SEQ ID NO: 1694 - DNA, 16 bp, Artificial sequence
  Synthetic oligonucleotide
gtgctgaaagcgggct

SEQ ID NO: 1695 - DNA, 16 bp, Artificial sequence
  Synthetic oligonucleotide
cgtgctgaaagcgggc

SEQ ID NO: 1696 - DNA, 16 bp, Artificial sequence
  Synthetic oligonucleotide
tcagcccctggttacg

SEQ ID NO: 1697 - DNA, 16 bp, Artificial sequence
  Synthetic oligonucleotide
attgtcagcccctggt

SEQ ID NO: 1698 - DNA, 16 bp, Artificial sequence
  Synthetic oligonucleotide
gcattgtcagcccctg

SEQ ID NO: 1699 - DNA, 16 bp, Artificial sequence
  Synthetic oligonucleotide
cgcattgtcagcccct

SEQ ID NO: 1700 - DNA, 16 bp, Artificial sequence
  Synthetic oligonucleotide
tcgcattgtcagcccc

SEQ ID NO: 1701 - DNA, 16 bp, Artificial sequence
  Synthetic oligonucleotide
ctcgcattgtcagccc

SEQ ID NO: 1702 - DNA, 16 bp, Artificial sequence
  Synthetic oligonucleotide
cctcgcattgtcagcc

SEQ ID NO: 1703 - DNA, 16 bp, Artificial sequence
  Synthetic oligonucleotide
acctcgcattgtcagc

SEQ ID NO: 1704 - DNA, 16 bp, Artificial sequence
  Synthetic oligonucleotide
gacctcgcattgtcag

SEQ ID NO: 1705 - DNA, 16 bp, Artificial sequence
  Synthetic oligonucleotide
cgacctcgcattgtca

SEQ ID NO: 1706 - DNA, 16 bp, Artificial sequence
  Synthetic oligonucleotide
gcgacctcgcattgtc

SEQ ID NO: 1707 - DNA, 16 bp, Artificial sequence
  Synthetic oligonucleotide
tgcgacctcgcattgt

SEQ ID NO: 1708 - DNA, 16 bp, Artificial sequence
  Synthetic oligonucleotide
ttgcgacctcgcattg

SEQ ID NO: 1709 - DNA, 16 bp, Artificial sequence
  Synthetic oligonucleotide
gttgcgacctcgcatt

SEQ ID NO: 1710 - DNA, 16 bp, Artificial sequence
  Synthetic oligonucleotide
agttgcgacctcgcat

SEQ ID NO: 1711 - DNA, 16 bp, Artificial sequence
  Synthetic oligonucleotide
cagttgcgacctcgca

SEQ ID NO: 1712 - DNA, 16 bp, Artificial sequence
  Synthetic oligonucleotide
tcagttgcgacctcgc

SEQ ID NO: 1713 - DNA, 16 bp, Artificial sequence
  Synthetic oligonucleotide
ctcagttgcgacctcg

SEQ ID NO: 1714 - DNA, 16 bp, Artificial sequence
  Synthetic oligonucleotide
tctcagttgcgacctc

SEQ ID NO: 1715 - DNA, 16 bp, Artificial sequence
  Synthetic oligonucleotide
atctcagttgcgacct

SEQ ID NO: 1716 - DNA, 16 bp, Artificial sequence
  Synthetic oligonucleotide
gatctcagttgcgacc

SEQ ID NO: 1717 - DNA, 16 bp, Artificial sequence
  Synthetic oligonucleotide
agatctcagttgcgac

SEQ ID NO: 1718 - DNA, 16 bp, Artificial sequence
  Synthetic oligonucleotide
gagatctcagttgcga

SEQ ID NO: 1719 - DNA, 16 bp, Artificial sequence
  Synthetic oligonucleotide
ggagatctcagttgcg

SEQ ID NO: 1720 - DNA, 16 bp, Artificial sequence
  Synthetic oligonucleotide
tcatggagatctcagt

SEQ ID NO: 1721 - DNA, 16 bp, Artificial sequence
  Synthetic oligonucleotide
gtcatggagatctcag

SEQ ID NO: 1722 - DNA, 16 bp, Artificial sequence
  Synthetic oligonucleotide
agtcatggagatctca

SEQ ID NO: 1723 - DNA, 16 bp, Artificial sequence
  Synthetic oligonucleotide
cagtcatggagatctc

SEQ ID NO: 1724 - DNA, 16 bp, Artificial sequence
  Synthetic oligonucleotide
acagtcatggagatct

SEQ ID NO: 1725 - DNA, 16 bp, Artificial sequence
  Synthetic oligonucleotide
aacacacagtcatgga

SEQ ID NO: 1726 - DNA, 16 bp, Artificial sequence
  Synthetic oligonucleotide
caacacacagtcatgg

SEQ ID NO: 1727 - DNA, 16 bp, Artificial sequence
  Synthetic oligonucleotide
catcctatccgtgttc

SEQ ID NO: 1728 - DNA, 16 bp, Artificial sequence
  Synthetic oligonucleotide
catgaacatcctatcc

SEQ ID NO: 1729 - DNA, 16 bp, Artificial sequence
  Synthetic oligonucleotide
tattccatgaacatcc

SEQ ID NO: 1730 - DNA, 16 bp, Artificial sequence
  Synthetic oligonucleotide
gtcaacatattccatg

SEQ ID NO: 1731 - DNA, 16 bp, Artificial sequence
  Synthetic oligonucleotide
cctgtcaacatattcc

SEQ ID NO: 1732 - DNA, 16 bp, Artificial sequence
  Synthetic oligonucleotide
tgtcctgtcaacatat

SEQ ID NO: 1733 - DNA, 16 bp, Artificial sequence
  Synthetic oligonucleotide
gccaacagtttcaact

SEQ ID NO: 1734 - DNA, 16 bp, Artificial sequence
  Synthetic oligonucleotide
ttctgccaacagtttc

SEQ ID NO: 1735 - DNA, 16 bp, Artificial sequence
  Synthetic oligonucleotide
caatattgactttggg

SEQ ID NO: 1736 - DNA, 16 bp, Artificial sequence
  Synthetic oligonucleotide
tgcttggcttcaatat

SEQ ID NO: 1737 - DNA, 16 bp, Artificial sequence
  Synthetic oligonucleotide
actgcaggcaatattt

SEQ ID NO: 1738 - DNA, 16 bp, Artificial sequence
  Synthetic oligonucleotide
gcactgcaggcaatat

SEQ ID NO: 1739 - DNA, 16 bp, Artificial sequence
  Synthetic oligonucleotide
ctaatgtggcactgca

SEQ ID NO: 1740 - DNA, 16 bp, Artificial sequence
  Synthetic oligonucleotide
tgttctaatgtggcac

SEQ ID NO: 1741 - DNA, 16 bp, Artificial sequence
  Synthetic oligonucleotide
gctgttctaatgtggc

SEQ ID NO: 1742 - DNA, 16 bp, Artificial sequence
  Synthetic oligonucleotide
tgactagtgaatggct

SEQ ID NO: 1743 - DNA, 16 bp, Artificial sequence
  Synthetic oligonucleotide
tctgactagtgaatgg

SEQ ID NO: 1744 - DNA, 16 bp, Artificial sequence
  Synthetic oligonucleotide
tcaatctgactagtga

SEQ ID NO: 1745 - DNA, 16 bp, Artificial sequence
  Synthetic oligonucleotide
ggtcaatctgactagt

SEQ ID NO: 1746 - DNA, 16 bp, Artificial sequence
  Synthetic oligonucleotide
ctggtcaatctgacta

SEQ ID NO: 1747 - DNA, 16 bp, Artificial sequence
  Synthetic oligonucleotide
ctctggtcaatctgac

SEQ ID NO: 1748 - DNA, 16 bp, Artificial sequence
  Synthetic oligonucleotide
caatctctggtcaatc

SEQ ID NO: 1749 - DNA, 16 bp, Artificial sequence
  Synthetic oligonucleotide
caacaatctctggtca

SEQ ID NO: 1750 - DNA, 16 bp, Artificial sequence
  Synthetic oligonucleotide
accaacaatctctggt

SEQ ID NO: 1751 - DNA, 16 bp, Artificial sequence
  Synthetic oligonucleotide
agcccaccaacaatct

SEQ ID NO: 1752 - DNA, 16 bp, Artificial sequence
  Synthetic oligonucleotide
gacagcccaccaacaa

SEQ ID NO: 1753 - DNA, 16 bp, Artificial sequence
  Synthetic oligonucleotide
cagacagcccaccaac

SEQ ID NO: 1754 - DNA, 16 bp, Artificial sequence
  Synthetic oligonucleotide
gcatagaccccaacag

SEQ ID NO: 1755 - DNA, 16 bp, Artificial sequence
  Synthetic oligonucleotide
gtgcatagaccccaac

SEQ ID NO: 1756 - DNA, 16 bp, Artificial sequence
  Synthetic oligonucleotide
ctgtgcatagacccca

SEQ ID NO: 1757 - DNA, 16 bp, Artificial sequence
  Synthetic oligonucleotide
tcctgtgcatagaccc

SEQ ID NO: 1758 - DNA, 16 bp, Artificial sequence
  Synthetic oligonucleotide
gaaatcctgtgcatag

SEQ ID NO: 1759 - DNA, 16 bp, Artificial sequence
  Synthetic oligonucleotide
gcagaaatcctgtgca

SEQ ID NO: 1760 - DNA, 16 bp, Artificial sequence
  Synthetic oligonucleotide
actccagcagaaatcc

SEQ ID NO: 1761 - DNA, 16 bp, Artificial sequence
  Synthetic oligonucleotide
aatcatgccttgtggg

SEQ ID NO: 1762 - DNA, 16 bp, Artificial sequence
  Synthetic oligonucleotide
tagacccagaatcatg

SEQ ID NO: 1763 - DNA, 16 bp, Artificial sequence
  Synthetic oligonucleotide
ccatagacccagaatc

SEQ ID NO: 1764 - DNA, 16 bp, Artificial sequence
  Synthetic oligonucleotide
agtcaccatagaccca

SEQ ID NO: 1765 - DNA, 16 bp, Artificial sequence
  Synthetic oligonucleotide
taagtcaccatagacc

SEQ ID NO: 1766 - DNA, 16 bp, Artificial sequence
  Synthetic oligonucleotide
gtggccctcttaagtc

SEQ ID NO: 1767 - DNA, 16 bp, Artificial sequence
  Synthetic oligonucleotide
gttgtgtggccctctt

SEQ ID NO: 1768 - DNA, 16 bp, Artificial sequence
  Synthetic oligonucleotide
cattgttgtgtggccc

SEQ ID NO: 1769 - DNA, 16 bp, Artificial sequence
  Synthetic oligonucleotide
tactcattgttgtgtg

SEQ ID NO: 1770 - DNA, 16 bp, Artificial sequence
  Synthetic oligonucleotide
aatactcattgttgtg

SEQ ID NO: 1771 - DNA, 16 bp, Artificial sequence
  Synthetic oligonucleotide
gccatacatctgagga

SEQ ID NO: 1772 - DNA, 16 bp, Artificial sequence
  Synthetic oligonucleotide
attgtagccatacatc

SEQ ID NO: 1773 - DNA, 16 bp, Artificial sequence
  Synthetic oligonucleotide
ttattgtagccataca

SEQ ID NO: 1774 - DNA, 16 bp, Artificial sequence
  Synthetic oligonucleotide
tctagatgacctgaag

SEQ ID NO: 1775 - DNA, 16 bp, Artificial sequence
  Synthetic oligonucleotide
tacatctagatgacct

SEQ ID NO: 1776 - DNA, 16 bp, Artificial sequence
  Synthetic oligonucleotide
gtatacatctagatga

SEQ ID NO: 1777 - DNA, 16 bp, Artificial sequence
  Synthetic oligonucleotide
actcgcctttgtgact

SEQ ID NO: 1778 - DNA, 16 bp, Artificial sequence
  Synthetic oligonucleotide
tactcgcctttgtgac

SEQ ID NO: 1779 - DNA, 16 bp, Artificial sequence
  Synthetic oligonucleotide
atactcgcctttgtga

SEQ ID NO: 1780 - DNA, 16 bp, Artificial sequence
  Synthetic oligonucleotide
catactcgcctttgtg

SEQ ID NO: 1781 - DNA, 16 bp, Artificial sequence
  Synthetic oligonucleotide
gcatactcgcctttgt

SEQ ID NO: 1782 - DNA, 16 bp, Artificial sequence
  Synthetic oligonucleotide
atgcatactcgccttt

SEQ ID NO: 1783 - DNA, 16 bp, Artificial sequence
  Synthetic oligonucleotide
catgcatactcgcctt

SEQ ID NO: 1784 - DNA, 16 bp, Artificial sequence
  Synthetic oligonucleotide
ccatgcatactcgcct

SEQ ID NO: 1785 - DNA, 16 bp, Artificial sequence
  Synthetic oligonucleotide
ttccatgcatactcgc

SEQ ID NO: 1786 - DNA, 16 bp, Artificial sequence
  Synthetic oligonucleotide
cgattttccatgcata

SEQ ID NO: 1787 - DNA, 16 bp, Artificial sequence
  Synthetic oligonucleotide
tgcgattttccatgca

SEQ ID NO: 1788 - DNA, 16 bp, Artificial sequence
  Synthetic oligonucleotide
tgtgatgcgattttcc

SEQ ID NO: 1789 - DNA, 16 bp, Artificial sequence
  Synthetic oligonucleotide
ctttgtgatgcgattt

SEQ ID NO: 1790 - DNA, 16 bp, Artificial sequence
  Synthetic oligonucleotide
gcctttgtgatgcgat

SEQ ID NO: 1791 - DNA, 16 bp, Artificial sequence
  Synthetic oligonucleotide
actcgcctttgtgatg

SEQ ID NO: 1792 - DNA, 16 bp, Artificial sequence
  Synthetic oligonucleotide
tactcgcctttgtgat

SEQ ID NO: 1793 - DNA, 16 bp, Artificial sequence
  Synthetic oligonucleotide
cccatgcatactcgcc

SEQ ID NO: 1794 - DNA, 16 bp, Artificial sequence
  Synthetic oligonucleotide
ccccatgcatactcgc

SEQ ID NO: 1795 - DNA, 16 bp, Artificial sequence
  Synthetic oligonucleotide
gctccccatgcatact

SEQ ID NO: 1796 - DNA, 16 bp, Artificial sequence
  Synthetic oligonucleotide
agtgctccccatgcat

SEQ ID NO: 1797 - DNA, 16 bp, Artificial sequence
  Synthetic oligonucleotide
caagtgctccccatgc

SEQ ID NO: 1798 - DNA, 16 bp, Artificial sequence
  Synthetic oligonucleotide
gtgatgaaagtacagc

SEQ ID NO: 1799 - DNA, 16 bp, Artificial sequence
  Synthetic oligonucleotide
aggagtttgtcagaac

SEQ ID NO: 1800 - DNA, 16 bp, Artificial sequence
  Synthetic oligonucleotide
ttcagggagtgatgtc

SEQ ID NO: 1801 - DNA, 16 bp, Artificial sequence
  Synthetic oligonucleotide
cctatccgtgttcagc

SEQ ID NO: 1802 - DNA, 16 bp, Artificial sequence
  Synthetic oligonucleotide
ctctacatactcagga

SEQ ID NO: 1803 - DNA, 16 bp, Artificial sequence
  Synthetic oligonucleotide
cagtccaaaaatccct

SEQ ID NO: 1804 - DNA, 16 bp, Artificial sequence
  Synthetic oligonucleotide
cctcttgatttgggca

SEQ ID NO: 1805 - DNA, 16 bp, Artificial sequence
  Synthetic oligonucleotide
ttggccaactctgtgg

SEQ ID NO: 1806 - DNA, 16 bp, Artificial sequence
  Synthetic oligonucleotide
gacctccagactactg

SEQ ID NO: 1807 - DNA, 16 bp, Artificial sequence
  Synthetic oligonucleotide
tgtgtctagggagttg

SEQ ID NO: 1808 - DNA, 16 bp, Artificial sequence
  Synthetic oligonucleotide
agcacacaattactgg

SEQ ID NO: 1809 - DNA, 16 bp, Artificial sequence
  Synthetic oligonucleotide
ctgctggttttagacc

SEQ ID NO: 1810 - DNA, 16 bp, Artificial sequence
  Synthetic oligonucleotide
ttcacttaccacagga

SEQ ID NO: 1811 - DNA, 16 bp, Artificial sequence
  Synthetic oligonucleotide
ggtgccacttgcttgg

SEQ ID NO: 1812 - DNA, 16 bp, Artificial sequence
  Synthetic oligonucleotide
aatctccacccccgaa

SEQ ID NO: 1813 - DNA, 16 bp, Artificial sequence
  Synthetic oligonucleotide
tacctgacaagtggtc

SEQ ID NO: 1814 - DNA, 16 bp, Artificial sequence
  Synthetic oligonucleotide
gtcccaagacattcct

SEQ ID NO: 1815 - DNA, 16 bp, Artificial sequence
  Synthetic oligonucleotide
cagagtgtcatctgcg

SEQ ID NO: 1816 - DNA, 16 bp, Artificial sequence
  Synthetic oligonucleotide
ggattggacccagaca

SEQ ID NO: 1817 - DNA, 16 bp, Artificial sequence
  Synthetic oligonucleotide
ggttccctagcggtcc

SEQ ID NO: 1818 - DNA, 16 bp, Artificial sequence
  Synthetic oligonucleotide
cacctagaactatcca

SEQ ID NO: 1819 - DNA, 16 bp, Artificial sequence
  Synthetic oligonucleotide
ctccctctgtaatgat

SEQ ID NO: 1820 - DNA, 16 bp, Artificial sequence
  Synthetic oligonucleotide
ggttgagggacagaca

SEQ ID NO: 1821 - DNA, 16 bp, Artificial sequence
  Synthetic oligonucleotide
gtgggtttgcacatgg

SEQ ID NO: 1822 - DNA, 16 bp, Artificial sequence
  Synthetic oligonucleotide
ggcttatgctccttct

SEQ ID NO: 1823 - DNA, 16 bp, Artificial sequence
  Synthetic oligonucleotide
ccccctgtagttggct

SEQ ID NO: 1824 - DNA, 16 bp, Artificial sequence
  Synthetic oligonucleotide
gcttacttacatccct

SEQ ID NO: 1825 - DNA, 16 bp, Artificial sequence
  Synthetic oligonucleotide
gggactacatgcaata

SEQ ID NO: 1826 - DNA, 16 bp, Artificial sequence
  Synthetic oligonucleotide
gtcaaagagtgtccac

SEQ ID NO: 1827 - DNA, 16 bp, Artificial sequence
  Synthetic oligonucleotide
gaatagcaagctccaa

SEQ ID NO: 1828 - DNA, 16 bp, Artificial sequence
  Synthetic oligonucleotide
catgataccacaccac

SEQ ID NO: 1829 - DNA, 16 bp, Artificial sequence
  Synthetic oligonucleotide
gagcactcttattagc

SEQ ID NO: 1830 - DNA, 16 bp, Artificial sequence
  Synthetic oligonucleotide
cctgttagagttggcc

SEQ ID NO: 1831 - DNA, 16 bp, Artificial sequence
  Synthetic oligonucleotide
aggacactgtttccag

SEQ ID NO: 1832 - DNA, 16 bp, Artificial sequence
  Synthetic oligonucleotide
gtcaccagaaccacat

SEQ ID NO: 1833 - DNA, 16 bp, Artificial sequence
  Synthetic oligonucleotide
gtgtgcactttctggt

SEQ ID NO: 1834 - DNA, 16 bp, Artificial sequence
  Synthetic oligonucleotide
ctctgattgggtcacc

SEQ ID NO: 1835 - DNA, 16 bp, Artificial sequence
  Synthetic oligonucleotide
accaacaactcaggcc

SEQ ID NO: 1836 - DNA, 16 bp, Artificial sequence
  Synthetic oligonucleotide
actctcaagctccacg

SEQ ID NO: 1837 - DNA, 16 bp, Artificial sequence
  Synthetic oligonucleotide
ggacaatatgtctcct

SEQ ID NO: 1838 - DNA, 16 bp, Artificial sequence
  Synthetic oligonucleotide
cattgtgctcaactga

SEQ ID NO: 1839 - DNA, 16 bp, Artificial sequence
  Synthetic oligonucleotide
gcccatggtgaatctg

SEQ ID NO: 1840 - DNA, 16 bp, Artificial sequence
  Synthetic oligonucleotide
cctagtacaaagtggc

SEQ ID NO: 1841 - DNA, 16 bp, Artificial sequence
  Synthetic oligonucleotide
gccattttatccctga

SEQ ID NO: 1842 - DNA, 16 bp, Artificial sequence
  Synthetic oligonucleotide
gggcccccatgtccat

SEQ ID NO: 1843 - DNA, 16 bp, Artificial sequence
  Synthetic oligonucleotide
gttcttgcttatcctc

SEQ ID NO: 1844 - DNA, 16 bp, Artificial sequence
  Synthetic oligonucleotide
atgtgacagtcaggga

SEQ ID NO: 1845 - DNA, 16 bp, Artificial sequence
  Synthetic oligonucleotide
ttctgcaactgagcct

SEQ ID NO: 1846 - DNA, 16 bp, Artificial sequence
  Synthetic oligonucleotide
aatggcaggtcctggc

SEQ ID NO: 1847 - DNA, 16 bp, Artificial sequence
  Synthetic oligonucleotide
agacagttggtggttt

SEQ ID NO: 1848 - DNA, 16 bp, Artificial sequence
  Synthetic oligonucleotide
gaggagttggtttagt

SEQ ID NO: 1849 - DNA, 16 bp, Artificial sequence
  Synthetic oligonucleotide
tgaccacctctcgggt

SEQ ID NO: 1850 - DNA, 16 bp, Artificial sequence
  Synthetic oligonucleotide
atttggccctgagccc

SEQ ID NO: 1851 - DNA, 16 bp, Artificial sequence
  Synthetic oligonucleotide
gcctttgagggagtgg

SEQ ID NO: 1852 - DNA, 16 bp, Artificial sequence
  Synthetic oligonucleotide
acaacctgtccattcc

SEQ ID NO: 1853 - DNA, 16 bp, Artificial sequence
  Synthetic oligonucleotide
gttgtcaactgggacc

SEQ ID NO: 1854 - DNA, 16 bp, Artificial sequence
  Synthetic oligonucleotide
ctgttcaggtagcaca

SEQ ID NO: 1855 - DNA, 16 bp, Artificial sequence
  Synthetic oligonucleotide
ccgggaaagactgtct

SEQ ID NO: 1856 - DNA, 16 bp, Artificial sequence
  Synthetic oligonucleotide
actgcaccccacatat

SEQ ID NO: 1857 - DNA, 16 bp, Artificial sequence
  Synthetic oligonucleotide
cctcatctcagtatga

SEQ ID NO: 1858 - DNA, 16 bp, Artificial sequence
  Synthetic oligonucleotide
gcacacagacttgccc

SEQ ID NO: 1859 - DNA, 16 bp, Artificial sequence
  Synthetic oligonucleotide
ctgcatctggactatg

SEQ ID NO: 1860 - DNA, 16 bp, Artificial sequence
  Synthetic oligonucleotide
agggaaattagaggca

SEQ ID NO: 1861 - DNA, 16 bp, Artificial sequence
  Synthetic oligonucleotide
ctgttgcctgacatgc

SEQ ID NO: 1862 - DNA, 16 bp, Artificial sequence
  Synthetic oligonucleotide
acataaattccccaca

SEQ ID NO: 1863 - DNA, 16 bp, Artificial sequence
  Synthetic oligonucleotide
cccactgactgactac

SEQ ID NO: 1864 - DNA, 16 bp, Artificial sequence
  Synthetic oligonucleotide
tcctgtgacagaacca

SEQ ID NO: 1865 - DNA, 16 bp, Artificial sequence
  Synthetic oligonucleotide
ctacacctttctgcac

SEQ ID NO: 1866 - DNA, 16 bp, Artificial sequence
  Synthetic oligonucleotide
ggtccttgaaccccgt

SEQ ID NO: 1867 - DNA, 16 bp, Artificial sequence
  Synthetic oligonucleotide
agcagatctgggttgt

SEQ ID NO: 1868 - DNA, 16 bp, Artificial sequence
  Synthetic oligonucleotide
gactagcttctactac

SEQ ID NO: 1869 - DNA, 16 bp, Artificial sequence
  Synthetic oligonucleotide
acaatcccttagccca

SEQ ID NO: 1870 - DNA, 16 bp, Artificial sequence
  Synthetic oligonucleotide
gatgaaatgtgcacct

SEQ ID NO: 1871 - DNA, 16 bp, Artificial sequence
  Synthetic oligonucleotide
gactgtgctatccgct

SEQ ID NO: 1872 - DNA, 16 bp, Artificial sequence
  Synthetic oligonucleotide
gctcactataggcccc

SEQ ID NO: 1873 - DNA, 16 bp, Artificial sequence
  Synthetic oligonucleotide
tagcatcatgccacag

SEQ ID NO: 1874 - DNA, 16 bp, Artificial sequence
  Synthetic oligonucleotide
gcacattaggaggtag

SEQ ID NO: 1875 - DNA, 16 bp, Artificial sequence
  Synthetic oligonucleotide
taccgctgggtgcggt

SEQ ID NO: 1876 - DNA, 16 bp, Artificial sequence
  Synthetic oligonucleotide
atgaaactgtggctcg

SEQ ID NO: 1877 - DNA, 16 bp, Artificial sequence
  Synthetic oligonucleotide
acatgtgggatcagag

SEQ ID NO: 1878 - DNA, 16 bp, Artificial sequence
  Synthetic oligonucleotide
gatgatcctcacatac

SEQ ID NO: 1879 - DNA, 16 bp, Artificial sequence
  Synthetic oligonucleotide
tagaaccttcctccac

SEQ ID NO: 1880 - DNA, 16 bp, Artificial sequence
  Synthetic oligonucleotide
ggaagacttccctctg

SEQ ID NO: 1881 - DNA, 16 bp, Artificial sequence
  Synthetic oligonucleotide
tagtgataagagctgg

SEQ ID NO: 1882 - DNA, 16 bp, Artificial sequence
  Synthetic oligonucleotide
ggcaactatgttctca

SEQ ID NO: 1883 - DNA, 16 bp, Artificial sequence
  Synthetic oligonucleotide
ctaactccatcactgc

SEQ ID NO: 1884 - DNA, 16 bp, Artificial sequence
  Synthetic oligonucleotide
tccccaatacttgctg

SEQ ID NO: 1885 - DNA, 16 bp, Artificial sequence
  Synthetic oligonucleotide
gctgttctaagcgaga

SEQ ID NO: 1886 - DNA, 16 bp, Artificial sequence
  Synthetic oligonucleotide
tgagtgatgccttcca

SEQ ID NO: 1887 - DNA, 16 bp, Artificial sequence
  Synthetic oligonucleotide
tccagaatactgcccc

SEQ ID NO: 1888 - DNA, 16 bp, Artificial sequence
  Synthetic oligonucleotide
gcgctaacctcataaa

SEQ ID NO: 1889 - DNA, 16 bp, Artificial sequence
  Synthetic oligonucleotide
ctggaaacgagacaca

SEQ ID NO: 1890 - DNA, 16 bp, Artificial sequence
  Synthetic oligonucleotide
gagagagatgttccct

SEQ ID NO: 1891 - DNA, 16 bp, Artificial sequence
  Synthetic oligonucleotide
ctgctggttgagaatc

SEQ ID NO: 1892 - DNA, 16 bp, Artificial sequence
  Synthetic oligonucleotide
atgtccccagtggaag

SEQ ID NO: 1893 - DNA, 16 bp, Artificial sequence
  Synthetic oligonucleotide
gcatcctccctagttg

SEQ ID NO: 1894 - DNA, 16 bp, Artificial sequence
  Synthetic oligonucleotide
tgttggtcagcattca

SEQ ID NO: 1895 - DNA, 16 bp, Artificial sequence
  Synthetic oligonucleotide
gacgactgccctgtgc

SEQ ID NO: 1896 - DNA, 16 bp, Artificial sequence
  Synthetic oligonucleotide
atttgggcctagtggt

SEQ ID NO: 1897 - DNA, 16 bp, Artificial sequence
  Synthetic oligonucleotide
cctagtcctcaagttt

SEQ ID NO: 1898 - DNA, 16 bp, Artificial sequence
  Synthetic oligonucleotide
caagacatcagtagct

SEQ ID NO: 1899 - DNA, 16 bp, Artificial sequence
  Synthetic oligonucleotide
cttatcagtcccagtc

SEQ ID NO: 1900 - DNA, 16 bp, Artificial sequence
  Synthetic oligonucleotide
gacaacccatcagttg

SEQ ID NO: 1901 - DNA, 16 bp, Artificial sequence
  Synthetic oligonucleotide
cagcaggctcaaagtg

SEQ ID NO: 1902 - DNA, 16 bp, Artificial sequence
  Synthetic oligonucleotide
tggctaagtcaggccc

SEQ ID NO: 1903 - DNA, 16 bp, Artificial sequence
  Synthetic oligonucleotide
tgtactccacctcacg

SEQ ID NO: 1904 - DNA, 16 bp, Artificial sequence
  Synthetic oligonucleotide
agcaagctaagtgagt

SEQ ID NO: 1905 - DNA, 16 bp, Artificial sequence
  Synthetic oligonucleotide
gttcttgagtgtagag

SEQ ID NO: 1906 - DNA, 16 bp, Artificial sequence
  Synthetic oligonucleotide
gtgttcatacggaagc

SEQ ID NO: 1907 - DNA, 16 bp, Artificial sequence
  Synthetic oligonucleotide
gttgggatgcgactct

SEQ ID NO: 1908 - DNA, 16 bp, Artificial sequence
  Synthetic oligonucleotide
acgaagtctctttcct

SEQ ID NO: 1909 - DNA, 16 bp, Artificial sequence
  Synthetic oligonucleotide
cgatgagttgggcagg

SEQ ID NO: 1910 - DNA, 16 bp, Artificial sequence
  Synthetic oligonucleotide
gatacctttccactcc

SEQ ID NO: 1911 - DNA, 16 bp, Artificial sequence
  Synthetic oligonucleotide
tccccaagattatgtg

SEQ ID NO: 1912 - DNA, 16 bp, Artificial sequence
  Synthetic oligonucleotide
gcacccttttcattga

SEQ ID NO: 1913 - DNA, 16 bp, Artificial sequence
  Synthetic oligonucleotide
tcgacttctcctgtct

SEQ ID NO: 1914 - DNA, 16 bp, Artificial sequence
  Synthetic oligonucleotide
gcctttgacctttcgc

SEQ ID NO: 1915 - DNA, 16 bp, Artificial sequence
  Synthetic oligonucleotide
gtgtgctgaggtttgc

SEQ ID NO: 1916 - DNA, 16 bp, Artificial sequence
  Synthetic oligonucleotide
gcaagatgcatgcagc

SEQ ID NO: 1917 - DNA, 16 bp, Artificial sequence
  Synthetic oligonucleotide
atcgaactctgcttga

SEQ ID NO: 1918 - DNA, 16 bp, Artificial sequence
  Synthetic oligonucleotide
gcccagttttggcaac

SEQ ID NO: 1919 - DNA, 16 bp, Artificial sequence
  Synthetic oligonucleotide
cccactaccatttggg

SEQ ID NO: 1920 - DNA, 16 bp, Artificial sequence
  Synthetic oligonucleotide
caactataacagtatc

SEQ ID NO: 1921 - DNA, 16 bp, Artificial sequence
  Synthetic oligonucleotide
ctataccacggtaact

SEQ ID NO: 1922 - DNA, 16 bp, Artificial sequence
  Synthetic oligonucleotide
cctatatcactgtaac

SEQ ID NO: 1923 - DNA, 16 bp, Artificial sequence
  Synthetic oligonucleotide
acctatatcactgtaa

SEQ ID NO: 1924 - DNA, 16 bp, Artificial sequence
  Synthetic oligonucleotide
tcactgtacctatatc

SEQ ID NO: 1925 - DNA, 16 bp, Artificial sequence
  Synthetic oligonucleotide
gtcctataactatatc

SEQ ID NO: 1926 - DNA, 16 bp, Artificial sequence
  Synthetic oligonucleotide
ctgtacctataactgt

SEQ ID NO: 1927 - DNA, 16 bp, Artificial sequence
  Synthetic oligonucleotide
cgtcactgtacctata

SEQ ID NO: 1928 - DNA, 16 bp, Artificial sequence
  Synthetic oligonucleotide
catcactgtacctata

SEQ ID NO: 1929 - DNA, 16 bp, Artificial sequence
  Synthetic oligonucleotide
caacatcactgtacct

SEQ ID NO: 1930 - DNA, 16 bp, Artificial sequence
  Synthetic oligonucleotide
ttccctacccctggta

SEQ ID NO: 1931 - DNA, 16 bp, Artificial sequence
  Synthetic oligonucleotide
ggtggaatgtcatggc

SEQ ID NO: 1932 - DNA, 16 bp, Artificial sequence
  Synthetic oligonucleotide
gcggaaaactggccgt

SEQ ID NO: 1933 - DNA, 16 bp, Artificial sequence
  Synthetic oligonucleotide
cccaatacagggccag

SEQ ID NO: 1934 - DNA, 16 bp, Artificial sequence
  Synthetic oligonucleotide
ccaaccttcccaatct

SEQ ID NO: 1935 - DNA, 16 bp, Artificial sequence
  Synthetic oligonucleotide
gaaggtgtgctgtcgc

SEQ ID NO: 1936 - DNA, 16 bp, Artificial sequence
  Synthetic oligonucleotide
atcgagtcctgcctcc

SEQ ID NO: 1937 - DNA, 16 bp, Artificial sequence
  Synthetic oligonucleotide
gcaaatccttccagca

SEQ ID NO: 1938 - DNA, 16 bp, Artificial sequence
  Synthetic oligonucleotide
gcacgagcttgcctgt

SEQ ID NO: 1939 - DNA, 16 bp, Artificial sequence
  Synthetic oligonucleotide
gagccatccagggtgc

SEQ ID NO: 1940 - DNA, 16 bp, Artificial sequence
  Synthetic oligonucleotide
aggccatttgatccga

SEQ ID NO: 1941 - DNA, 16 bp, Artificial sequence
  Synthetic oligonucleotide
gccacgcccttagcag

SEQ ID NO: 1942 - DNA, 16 bp, Artificial sequence
  Synthetic oligonucleotide
gttccctgaggaacgg

SEQ ID NO: 1943 - DNA, 16 bp, Artificial sequence
  Synthetic oligonucleotide
ggcagttaggccagga

SEQ ID NO: 1944 - DNA, 16 bp, Artificial sequence
  Synthetic oligonucleotide
ctacagatcatcccta

SEQ ID NO: 1945 - DNA, 16 bp, Artificial sequence
  Synthetic oligonucleotide
ccccggagcaccttca

SEQ ID NO: 1946 - DNA, 16 bp, Artificial sequence
  Synthetic oligonucleotide
gtgacccaagggtcga

SEQ ID NO: 1947 - DNA, 16 bp, Artificial sequence
  Synthetic oligonucleotide
cgtggttagcctgaca

SEQ ID NO: 1948 - DNA, 16 bp, Artificial sequence
  Synthetic oligonucleotide
tccatgtcagagttgc

SEQ ID NO: 1949 - DNA, 16 bp, Artificial sequence
  Synthetic oligonucleotide
cctccttttggcttga

SEQ ID NO: 1950 - DNA, 16 bp, Artificial sequence
  Synthetic oligonucleotide
ttccccagaggtgata

SEQ ID NO: 1951 - DNA, 16 bp, Artificial sequence
  Synthetic oligonucleotide
tctggttagcctccga

SEQ ID NO: 1952 - DNA, 16 bp, Artificial sequence
  Synthetic oligonucleotide
tggccaagcaaccagt

SEQ ID NO: 1953 - DNA, 16 bp, Artificial sequence
  Synthetic oligonucleotide
gcccaatgtcctaacc

SEQ ID NO: 1954 - DNA, 16 bp, Artificial sequence
  Synthetic oligonucleotide
ccaccgctgcccgcca

SEQ ID NO: 1955 - DNA, 16 bp, Artificial sequence
  Synthetic oligonucleotide
tgtgaccccccaccgc

SEQ ID NO: 1956 - DNA, 16 bp, Artificial sequence
  Synthetic oligonucleotide
ttgtgaccccccaccg

SEQ ID NO: 1957 - DNA, 16 bp, Artificial sequence
  Synthetic oligonucleotide
actgaacccccttagg

SEQ ID NO: 1958 - DNA, 16 bp, Artificial sequence
  Synthetic oligonucleotide
ccttcatacccctcac

SEQ ID NO: 1959 - DNA, 16 bp, Artificial sequence
  Synthetic oligonucleotide
ccgataacagaccggc

SEQ ID NO: 1960 - DNA, 16 bp, Artificial sequence
  Synthetic oligonucleotide
atacccggagtcagga

SEQ ID NO: 1961 - DNA, 16 bp, Artificial sequence
  Synthetic oligonucleotide
attgctcaggccccct

SEQ ID NO: 1962 - DNA, 16 bp, Artificial sequence
  Synthetic oligonucleotide
caagccactaacccac

SEQ ID NO: 1963 - DNA, 16 bp, Artificial sequence
  Synthetic oligonucleotide
aattcttggaccaagg

SEQ ID NO: 1964 - DNA, 16 bp, Artificial sequence
  Synthetic oligonucleotide
ccatctactcccccat

SEQ ID NO: 1965 - DNA, 16 bp, Artificial sequence
  Synthetic oligonucleotide
gcagcgagcattccaa

SEQ ID NO: 1966 - DNA, 16 bp, Artificial sequence
  Synthetic oligonucleotide
ggacaatgcctatgct

SEQ ID NO: 1967 - DNA, 16 bp, Artificial sequence
  Synthetic oligonucleotide
gaagccattcactgca

SEQ ID NO: 1968 - DNA, 16 bp, Artificial sequence
  Synthetic oligonucleotide
aaactcctctcaaggc

SEQ ID NO: 1969 - DNA, 16 bp, Artificial sequence
  Synthetic oligonucleotide
gcaccaccatgcggtt

SEQ ID NO: 1970 - DNA, 16 bp, Artificial sequence
  Synthetic oligonucleotide
tgcagggctgcgcagt

SEQ ID NO: 1971 - DNA, 16 bp, Artificial sequence
  Synthetic oligonucleotide
ttagccactcctcttg

SEQ ID NO: 1972 - DNA, 16 bp, Artificial sequence
  Synthetic oligonucleotide
agctagctgaccccaa

SEQ ID NO: 1973 - DNA, 16 bp, Artificial sequence
  Synthetic oligonucleotide
tccgcctttggatact

SEQ ID NO: 1974 - DNA, 16 bp, Artificial sequence
  Synthetic oligonucleotide
cctgctgattgtgtct

SEQ ID NO: 1975 - DNA, 16 bp, Artificial sequence
  Synthetic oligonucleotide
tcgaggacagccccca

SEQ ID NO: 1976 - DNA, 16 bp, Artificial sequence
  Synthetic oligonucleotide
acccgtcagcctcagc

SEQ ID NO: 1977 - DNA, 16 bp, Artificial sequence
  Synthetic oligonucleotide
cttgcctattcacccc

SEQ ID NO: 1978 - DNA, 16 bp, Artificial sequence
  Synthetic oligonucleotide
cggacaagccttacag

SEQ ID NO: 1979 - DNA, 16 bp, Artificial sequence
  Synthetic oligonucleotide
cacacttaccccgctc

SEQ ID NO: 1980 - DNA, 16 bp, Artificial sequence
  Synthetic oligonucleotide
cctccccttgtgtgtc

SEQ ID NO: 1981 - DNA, 16 bp, Artificial sequence
  Synthetic oligonucleotide
ccgcttccctgactgt

SEQ ID NO: 1982 - DNA, 16 bp, Artificial sequence
  Synthetic oligonucleotide
cagctcccttactagg

SEQ ID NO: 1983 - DNA, 16 bp, Artificial sequence
  Synthetic oligonucleotide
aggtattgaccgccag

SEQ ID NO: 1984 - DNA, 16 bp, Artificial sequence
  Synthetic oligonucleotide
ggtaaatccatcccct

SEQ ID NO: 1985 - DNA, 16 bp, Artificial sequence
  Synthetic oligonucleotide
gcccgatcaccttaga

SEQ ID NO: 1986 - DNA, 16 bp, Artificial sequence
  Synthetic oligonucleotide
gtctaactggcctggc

SEQ ID NO: 1987 - DNA, 16 bp, Artificial sequence
  Synthetic oligonucleotide
ctaagctgtgtctcat

SEQ ID NO: 1988 - DNA, 16 bp, Artificial sequence
  Synthetic oligonucleotide
tgtttcaagtgccaga

SEQ ID NO: 1989 - DNA, 16 bp, Artificial sequence
  Synthetic oligonucleotide
tgcagtggtcaagcat

SEQ ID NO: 1990 - DNA, 16 bp, Artificial sequence
  Synthetic oligonucleotide
gcgattccttgcctct

SEQ ID NO: 1991 - DNA, 16 bp, Artificial sequence
  Synthetic oligonucleotide
ataatagaggcagcca

SEQ ID NO: 1992 - DNA, 16 bp, Artificial sequence
  Synthetic oligonucleotide
gtcagaaggcctctta

SEQ ID NO: 1993 - DNA, 16 bp, Artificial sequence
  Synthetic oligonucleotide
tatttatccgacctct

SEQ ID NO: 1994 - DNA, 16 bp, Artificial sequence
  Synthetic oligonucleotide
gaggtggttggagcta

SEQ ID NO: 1995 - DNA, 16 bp, Artificial sequence
  Synthetic oligonucleotide
cagatcccaattcttc

SEQ ID NO: 1996 - DNA, 16 bp, Artificial sequence
  Synthetic oligonucleotide
gagtctttccaatcct

SEQ ID NO: 1997 - DNA, 16 bp, Artificial sequence
  Synthetic oligonucleotide
tctcaatcccaacccc

SEQ ID NO: 1998 - DNA, 16 bp, Artificial sequence
  Synthetic oligonucleotide
cctcaatcccaaccca

SEQ ID NO: 1999 - DNA, 16 bp, Artificial sequence
  Synthetic oligonucleotide
tagtggcaagaaccac

SEQ ID NO: 2000 - DNA, 16 bp, Artificial sequence
  Synthetic oligonucleotide
cgcgcgaatgcctgcc

SEQ ID NO: 2001 - DNA, 16 bp, Artificial sequence
  Synthetic oligonucleotide
gacacctgcttgatta

SEQ ID NO: 2002 - DNA, 16 bp, Artificial sequence
  Synthetic oligonucleotide
ggcactggtcatggac

SEQ ID NO: 2003 - DNA, 16 bp, Artificial sequence
  Synthetic oligonucleotide
gcgccatccttcaatc

SEQ ID NO: 2004 - DNA, 16 bp, Artificial sequence
  Synthetic oligonucleotide
gatccacccatgacct

SEQ ID NO: 2005 - DNA, 16 bp, Artificial sequence
  Synthetic oligonucleotide
gctgtgactcagatca

SEQ ID NO: 2006 - DNA, 16 bp, Artificial sequence
  Synthetic oligonucleotide
ctcttcgcatggacac

SEQ ID NO: 2007 - DNA, 16 bp, Artificial sequence
  Synthetic oligonucleotide
gcccaagcctacatgc

SEQ ID NO: 2008 - DNA, 16 bp, Artificial sequence
  Synthetic oligonucleotide
gtgcgattaagcccca

SEQ ID NO: 2009 - DNA, 16 bp, Artificial sequence
  Synthetic oligonucleotide
gcttgtagaagggatt

SEQ ID NO: 2010 - DNA, 16 bp, Artificial sequence
  Synthetic oligonucleotide
tgtgcaatcaggtgga

SEQ ID NO: 2011 - DNA, 16 bp, Artificial sequence
  Synthetic oligonucleotide
ccggcctggatacagc

SEQ ID NO: 2012 - DNA, 16 bp, Artificial sequence
  Synthetic oligonucleotide
cggccaatgggaaagg

SEQ ID NO: 2013 - DNA, 16 bp, Artificial sequence
  Synthetic oligonucleotide
tggaggagtagggaat

SEQ ID NO: 2014 - DNA, 16 bp, Artificial sequence
  Synthetic oligonucleotide
cccgaagagtcaagtc

SEQ ID NO: 2015 - DNA, 16 bp, Artificial sequence
  Synthetic oligonucleotide
gtgctgcattgcatga

SEQ ID NO: 2016 - DNA, 16 bp, Artificial sequence
  Synthetic oligonucleotide
acacgccaggtgaaaa

SEQ ID NO: 2017 - DNA, 16 bp, Artificial sequence
  Synthetic oligonucleotide
atgcatgcctacccaa

SEQ ID NO: 2018 - DNA, 16 bp, Artificial sequence
  Synthetic oligonucleotide
gttactctgtgatcca

SEQ ID NO: 2019 - DNA, 16 bp, Artificial sequence
  Synthetic oligonucleotide
aacattgtgtagctgc

SEQ ID NO: 2020 - DNA, 16 bp, Artificial sequence
  Synthetic oligonucleotide
gagactgaagccctca

SEQ ID NO: 2021 - DNA, 16 bp, Artificial sequence
  Synthetic oligonucleotide
cactgcctagaaaggc

SEQ ID NO: 2022 - DNA, 16 bp, Artificial sequence
  Synthetic oligonucleotide
tgtagtatccagagta

SEQ ID NO: 2023 - DNA, 16 bp, Artificial sequence
  Synthetic oligonucleotide
agatgacctgcagatg

SEQ ID NO: 2024 - DNA, 16 bp, Artificial sequence
  Synthetic oligonucleotide
aaaccatgaattaggt

SEQ ID NO: 2025 - DNA, 16 bp, Artificial sequence
  Synthetic oligonucleotide
ttgctactttacacca

SEQ ID NO: 2026 - DNA, 16 bp, Artificial sequence
  Synthetic oligonucleotide
ggcattaggataggca

SEQ ID NO: 2027 - DNA, 16 bp, Artificial sequence
  Synthetic oligonucleotide
cactcagactgtctga

SEQ ID NO: 2028 - DNA, 16 bp, Artificial sequence
  Synthetic oligonucleotide
agatccggaataacca

SEQ ID NO: 2029 - DNA, 16 bp, Artificial sequence
  Synthetic oligonucleotide
attgacaaccatccta

SEQ ID NO: 2030 - DNA, 16 bp, Artificial sequence
  Synthetic oligonucleotide
actcattggtctacag

SEQ ID NO: 2031 - DNA, 16 bp, Artificial sequence
  Synthetic oligonucleotide
atgccttgtgcctatt

SEQ ID NO: 2032 - DNA, 16 bp, Artificial sequence
  Synthetic oligonucleotide
actctgaggccttagg

SEQ ID NO: 2033 - DNA, 16 bp, Artificial sequence
  Synthetic oligonucleotide
gcattactcagcatgt

SEQ ID NO: 2034 - DNA, 16 bp, Artificial sequence
  Synthetic oligonucleotide
ccagtcaccaccattg

SEQ ID NO: 2035 - DNA, 16 bp, Artificial sequence
  Synthetic oligonucleotide
ggtctaactctaaggg

SEQ ID NO: 2036 - DNA, 16 bp, Artificial sequence
  Synthetic oligonucleotide
tgtcctttaaagtatc

SEQ ID NO: 2037 - DNA, 16 bp, Artificial sequence
  Synthetic oligonucleotide
tcatgtggcaacctgt

SEQ ID NO: 2038 - DNA, 16 bp, Artificial sequence
  Synthetic oligonucleotide
aatctgcacctggcag

SEQ ID NO: 2039 - DNA, 16 bp, Artificial sequence
  Synthetic oligonucleotide
catggctattgcttcc

SEQ ID NO: 2040 - DNA, 16 bp, Artificial sequence
  Synthetic oligonucleotide
gggctatattgccagc

SEQ ID NO: 2041 - DNA, 16 bp, Artificial sequence
  Synthetic oligonucleotide
ccagagccttgatcag

SEQ ID NO: 2042 - DNA, 16 bp, Artificial sequence
  Synthetic oligonucleotide
ggtgggttatctgaga

SEQ ID NO: 2043 - DNA, 16 bp, Artificial sequence
  Synthetic oligonucleotide
tagctccatgctgtgt

SEQ ID NO: 2044 - DNA, 16 bp, Artificial sequence
  Synthetic oligonucleotide
gggaatttatgctgcc

SEQ ID NO: 2045 - DNA, 16 bp, Artificial sequence
  Synthetic oligonucleotide
tgatgaagttccacct

SEQ ID NO: 2046 - DNA, 16 bp, Artificial sequence
  Synthetic oligonucleotide
taggcacagacaacct

SEQ ID NO: 2047 - DNA, 16 bp, Artificial sequence
  Synthetic oligonucleotide
tccaactacaggactc

SEQ ID NO: 2048 - DNA, 16 bp, Artificial sequence
  Synthetic oligonucleotide
ttctgggaaactctct

SEQ ID NO: 2049 - DNA, 16 bp, Artificial sequence
  Synthetic oligonucleotide
agctcacacccaaaaa

SEQ ID NO: 2050 - DNA, 16 bp, Artificial sequence
  Synthetic oligonucleotide
tctgttaccttgagga

SEQ ID NO: 2051 - DNA, 16 bp, Artificial sequence
  Synthetic oligonucleotide
tggtcatgtcaactgt

SEQ ID NO: 2052 - DNA, 16 bp, Artificial sequence
  Synthetic oligonucleotide
gtaagccttcacaggg

SEQ ID NO: 2053 - DNA, 16 bp, Artificial sequence
  Synthetic oligonucleotide
ctcaccagagttgtcc

SEQ ID NO: 2054 - DNA, 16 bp, Artificial sequence
  Synthetic oligonucleotide
catccctgacaggtcc

SEQ ID NO: 2055 - DNA, 16 bp, Artificial sequence
  Synthetic oligonucleotide
cccttctaaccaagga

SEQ ID NO: 2056 - DNA, 16 bp, Artificial sequence
  Synthetic oligonucleotide
ggatgagatgcatcca

SEQ ID NO: 2057 - DNA, 16 bp, Artificial sequence
  Synthetic oligonucleotide
atggcggtgaagcagc

SEQ ID NO: 2058 - DNA, 16 bp, Artificial sequence
  Synthetic oligonucleotide
tgaataccatccccgc

SEQ ID NO: 2059 - DNA, 16 bp, Artificial sequence
  Synthetic oligonucleotide
gcgccatctgccctgt

SEQ ID NO: 2060 - DNA, 16 bp, Artificial sequence
  Synthetic oligonucleotide
tgggttggaggagtgg

SEQ ID NO: 2061 - DNA, 16 bp, Artificial sequence
  Synthetic oligonucleotide
tggtggtgggattggt

SEQ ID NO: 2062 - DNA, 16 bp, Artificial sequence
  Synthetic oligonucleotide
ttggtggtgggattgg

SEQ ID NO: 2063 - DNA, 16 bp, Artificial sequence
  Synthetic oligonucleotide
ggtggtggaattggtg

SEQ ID NO: 2064 - DNA, 16 bp, Artificial sequence
  Synthetic oligonucleotide
gagattggtggtgggt

SEQ ID NO: 2065 - DNA, 16 bp, Artificial sequence
  Synthetic oligonucleotide
gtggtgggattggtgc

SEQ ID NO: 2066 - DNA, 16 bp, Artificial sequence
  Synthetic oligonucleotide
tggcgggattggtggt

SEQ ID NO: 2067 - DNA, 16 bp, Artificial sequence
  Synthetic oligonucleotide
cggtggtgggattggt

SEQ ID NO: 2068 - DNA, 16 bp, Artificial sequence
  Synthetic oligonucleotide
tcggtggtgggattgg

SEQ ID NO: 2069 - DNA, 16 bp, Artificial sequence
  Synthetic oligonucleotide
atcggtggtgggattg

SEQ ID NO: 2070 - DNA, 16 bp, Artificial sequence
  Synthetic oligonucleotide
gatcggtggtgggatt

SEQ ID NO: 2071 - DNA, 16 bp, Artificial sequence
  Synthetic oligonucleotide
ggatcggtggtgggat

SEQ ID NO: 2072 - DNA, 16 bp, Artificial sequence
  Synthetic oligonucleotide
gcgggatcggtggtgg

SEQ ID NO: 2073 - DNA, 16 bp, Artificial sequence
  Synthetic oligonucleotide
ggcgggatcggtggtg

SEQ ID NO: 2074 - DNA, 16 bp, Artificial sequence
  Synthetic oligonucleotide
gagcaaatacagtcca

SEQ ID NO: 2075 - DNA, 16 bp, Artificial sequence
  Synthetic oligonucleotide
gtctcgatggcaagct

SEQ ID NO: 2076 - DNA, 16 bp, Artificial sequence
  Synthetic oligonucleotide
ctcaccggtactctgc

SEQ ID NO: 2077 - DNA, 16 bp, Artificial sequence
  Synthetic oligonucleotide
tcctggaggcaccaat

SEQ ID NO: 2078 - DNA, 16 bp, Artificial sequence
  Synthetic oligonucleotide
agccctgtttggtttt

SEQ ID NO: 2079 - DNA, 16 bp, Artificial sequence
  Synthetic oligonucleotide
tgaagggcgaggcgca

SEQ ID NO: 2080 - DNA, 16 bp, Artificial sequence
  Synthetic oligonucleotide
aagaggatgtcaggct

SEQ ID NO: 2081 - DNA, 16 bp, Artificial sequence
  Synthetic oligonucleotide
ttgaggaaagacctgc

SEQ ID NO: 2082 - DNA, 16 bp, Artificial sequence
  Synthetic oligonucleotide
gctgagtgtgacttaa

SEQ ID NO: 2083 - DNA, 16 bp, Artificial sequence
  Synthetic oligonucleotide
gtacatgactccagtg

SEQ ID NO: 2084 - DNA, 16 bp, Artificial sequence
  Synthetic oligonucleotide
gtagagcatggagcga

SEQ ID NO: 2085 - DNA, 16 bp, Artificial sequence
  Synthetic oligonucleotide
cgcttcaggaaagcga

SEQ ID NO: 2086 - DNA, 16 bp, Artificial sequence
  Synthetic oligonucleotide
ggcaggagactccgtg

SEQ ID NO: 2087 - DNA, 16 bp, Artificial sequence
  Synthetic oligonucleotide
atccttcccctcgcaa

SEQ ID NO: 2088 - DNA, 16 bp, Artificial sequence
  Synthetic oligonucleotide
taatgagtgggttagg

SEQ ID NO: 2089 - DNA, 16 bp, Artificial sequence
  Synthetic oligonucleotide
ggagcagtgcaggtaa

SEQ ID NO: 2090 - DNA, 16 bp, Artificial sequence
  Synthetic oligonucleotide
ataggcaattgttcct

SEQ ID NO: 2091 - DNA, 16 bp, Artificial sequence
  Synthetic oligonucleotide
agtcctacaattacca

SEQ ID NO: 2092 - DNA, 16 bp, Artificial sequence
  Synthetic oligonucleotide
gggctcctattccacc

SEQ ID NO: 2093 - DNA, 16 bp, Artificial sequence
  Synthetic oligonucleotide
gccagctatgggaaca

SEQ ID NO: 2094 - DNA, 16 bp, Artificial sequence
  Synthetic oligonucleotide
ccccatctcgaagccc

SEQ ID NO: 2095 - DNA, 16 bp, Artificial sequence
  Synthetic oligonucleotide
gagtacattgggccca

SEQ ID NO: 2096 - DNA, 16 bp, Artificial sequence
  Synthetic oligonucleotide
gagccttccgcctctc

SEQ ID NO: 2097 - DNA, 16 bp, Artificial sequence
  Synthetic oligonucleotide
cggaccttcatcttca

SEQ ID NO: 2098 - DNA, 16 bp, Artificial sequence
  Synthetic oligonucleotide
tctagaggccgcctgc

SEQ ID NO: 2099 - DNA, 16 bp, Artificial sequence
  Synthetic oligonucleotide
cctataactgctgctc

SEQ ID NO: 2100 - DNA, 16 bp, Artificial sequence
  Synthetic oligonucleotide
gtatcactgtactagt

SEQ ID NO: 2101 - DNA, 16 bp, Artificial sequence
  Synthetic oligonucleotide
agtatcactgtactag

SEQ ID NO: 2102 - DNA, 16 bp, Artificial sequence
  Synthetic oligonucleotide
cagtatcactgtacta

SEQ ID NO: 2103 - DNA, 16 bp, Artificial sequence
  Synthetic oligonucleotide
taacagtatcactgta

SEQ ID NO: 2104 - DNA, 16 bp, Artificial sequence
  Synthetic oligonucleotide
ctaacagtatcactgt

SEQ ID NO: 2105 - DNA, 16 bp, Artificial sequence
  Synthetic oligonucleotide
tctaacagtatcactg

SEQ ID NO: 2106 - DNA, 16 bp, Artificial sequence
  Synthetic oligonucleotide
ataactctaacagtat

SEQ ID NO: 2107 - DNA, 16 bp, Artificial sequence
  Synthetic oligonucleotide
ctataactctaacagt

SEQ ID NO: 2108 - DNA, 16 bp, Artificial sequence
  Synthetic oligonucleotide
actgtcctataactct

SEQ ID NO: 2109 - DNA, 16 bp, Artificial sequence
  Synthetic oligonucleotide
tatatcactgtcctat

SEQ ID NO: 2110 - DNA, 16 bp, Artificial sequence
  Synthetic oligonucleotide
cctatatcactgtcct

SEQ ID NO: 2111 - DNA, 16 bp, Artificial sequence
  Synthetic oligonucleotide
tcctatatcactgtcc

SEQ ID NO: 2112 - DNA, 16 bp, Artificial sequence
  Synthetic oligonucleotide
cactgtcctatatcac

SEQ ID NO: 2113 - DNA, 16 bp, Artificial sequence
  Synthetic oligonucleotide
gtatcactgtcctata

SEQ ID NO: 2114 - DNA, 16 bp, Artificial sequence
  Synthetic oligonucleotide
agtatcactgtcctat

SEQ ID NO: 2115 - DNA, 16 bp, Artificial sequence
  Synthetic oligonucleotide
cagtatcactgtccta

SEQ ID NO: 2116 - DNA, 16 bp, Artificial sequence
  Synthetic oligonucleotide
aacagtatcactgtcc

SEQ ID NO: 2117 - DNA, 16 bp, Artificial sequence
  Synthetic oligonucleotide
tataacagtatcactg

SEQ ID NO: 2118 - DNA, 16 bp, Artificial sequence
  Synthetic oligonucleotide
ctataacagtatcact

SEQ ID NO: 2119 - DNA, 16 bp, Artificial sequence
  Synthetic oligonucleotide
taactataacagtatc

SEQ ID NO: 2120 - DNA, 16 bp, Artificial sequence
  Synthetic oligonucleotide
tataactataacagta

SEQ ID NO: 2121 - DNA, 16 bp, Artificial sequence
  Synthetic oligonucleotide
cctataactataacag

SEQ ID NO: 2122 - DNA, 16 bp, Artificial sequence
  Synthetic oligonucleotide
tacctataactctaac

SEQ ID NO: 2123 - DNA, 16 bp, Artificial sequence
  Synthetic oligonucleotide
actgtacctataactc

SEQ ID NO: 2124 - DNA, 16 bp, Artificial sequence
  Synthetic oligonucleotide
tatcactgtacctata

SEQ ID NO: 2125 - DNA, 16 bp, Artificial sequence
  Synthetic oligonucleotide
acaatatcactgtacc

SEQ ID NO: 2126 - DNA, 16 bp, Artificial sequence
  Synthetic oligonucleotide
aacaatatcactgtac

SEQ ID NO: 2127 - DNA, 16 bp, Artificial sequence
  Synthetic oligonucleotide
atatcactgtacctgt

SEQ ID NO: 2128 - DNA, 16 bp, Artificial sequence
  Synthetic oligonucleotide
tatatcactgtacctg

SEQ ID NO: 2129 - DNA, 16 bp, Artificial sequence
  Synthetic oligonucleotide
ctatatcactgtacct

SEQ ID NO: 2130 - DNA, 16 bp, Artificial sequence
  Synthetic oligonucleotide
cctatatcactgtacc

SEQ ID NO: 2131 - DNA, 16 bp, Artificial sequence
  Synthetic oligonucleotide
cctataacagtatcac

SEQ ID NO: 2132 - DNA, 16 bp, Artificial sequence
  Synthetic oligonucleotide
tcctataacagtatca

SEQ ID NO: 2133 - DNA, 16 bp, Artificial sequence
  Synthetic oligonucleotide
ttcctataacagtatc

SEQ ID NO: 2134 - DNA, 16 bp, Artificial sequence
  Synthetic oligonucleotide
gtttcctataacagta

SEQ ID NO: 2135 - DNA, 16 bp, Artificial sequence
  Synthetic oligonucleotide
ctatgtcactgtacct

SEQ ID NO: 2136 - DNA, 16 bp, Artificial sequence
  Synthetic oligonucleotide
cctatgtcactgtacc

SEQ ID NO: 2137 - DNA, 16 bp, Artificial sequence
  Synthetic oligonucleotide
tcctatgtcactgtac

SEQ ID NO: 2138 - DNA, 16 bp, Artificial sequence
  Synthetic oligonucleotide
cactgtcctatgtcac

SEQ ID NO: 2139 - DNA, 16 bp, Artificial sequence
  Synthetic oligonucleotide
tcactgtcctatgtca

SEQ ID NO: 2140 - DNA, 16 bp, Artificial sequence
  Synthetic oligonucleotide
atcactgtcctatgtc

SEQ ID NO: 2141 - DNA, 16 bp, Artificial sequence
  Synthetic oligonucleotide
ctacctataactctaa

SEQ ID NO: 2142 - DNA, 16 bp, Artificial sequence
  Synthetic oligonucleotide
gtcctataactataac

SEQ ID NO: 2143 - DNA, 16 bp, Artificial sequence
  Synthetic oligonucleotide
tatatcactgtaccta

SEQ ID NO: 2144 - DNA, 16 bp, Artificial sequence
  Synthetic oligonucleotide
tacctataacagtatc

SEQ ID NO: 2145 - DNA, 16 bp, Artificial sequence
  Synthetic oligonucleotide
actgtacctataacag

SEQ ID NO: 2146 - DNA, 16 bp, Artificial sequence
  Synthetic oligonucleotide
caccgtactagtttcc

SEQ ID NO: 2147 - DNA, 16 bp, Artificial sequence
  Synthetic oligonucleotide
tataacagtatcaccg

SEQ ID NO: 2148 - DNA, 16 bp, Artificial sequence
  Synthetic oligonucleotide
ctataacagtatcacc

SEQ ID NO: 2149 - DNA, 16 bp, Artificial sequence
  Synthetic oligonucleotide
acctataactataaca

SEQ ID NO: 2150 - DNA, 16 bp, Artificial sequence
  Synthetic oligonucleotide
tggcgggatcggtggt

SEQ ID NO: 2151 - DNA, 16 bp, Artificial sequence
  Synthetic oligonucleotide
tggtggcgggatcggt

SEQ ID NO: 2152 - DNA, 16 bp, Artificial sequence
  Synthetic oligonucleotide
ttggtggcgggatcgg

SEQ ID NO: 2153 - DNA, 16 bp, Artificial sequence
  Synthetic oligonucleotide
attggtggcgggatcg

SEQ ID NO: 2154 - DNA, 16 bp, Artificial sequence
  Synthetic oligonucleotide
gattggtggcgggatc

SEQ ID NO: 2155 - DNA, 16 bp, Artificial sequence
  Synthetic oligonucleotide
gttggtggcgggatcg

SEQ ID NO: 2156 - DNA, 16 bp, Artificial sequence
  Synthetic oligonucleotide
ggttggtggcgggatc

SEQ ID NO: 2157 - DNA, 16 bp, Artificial sequence
  Synthetic oligonucleotide
tggttggtggcgggat

SEQ ID NO: 2158 - DNA, 16 bp, Artificial sequence
  Synthetic oligonucleotide
gaacacatcagggatt

SEQ ID NO: 2159 - DNA, 16 bp, Artificial sequence
  Synthetic oligonucleotide
tttctatgggcctgac

SEQ ID NO: 2160 - DNA, 16 bp, Artificial sequence
  Synthetic oligonucleotide
gctgtcacttaagcca

SEQ ID NO: 2161 - DNA, 16 bp, Artificial sequence
  Synthetic oligonucleotide
tctagggccacacctc

SEQ ID NO: 2162 - DNA, 16 bp, Artificial sequence
  Synthetic oligonucleotide
gttctacacacagtac

SEQ ID NO: 2163 - DNA, 16 bp, Artificial sequence
  Synthetic oligonucleotide
gcagtatgttcaatcc

SEQ ID NO: 2164 - DNA, 16 bp, Artificial sequence
  Synthetic oligonucleotide
cccacatgtaccaccg

SEQ ID NO: 2165 - DNA, 16 bp, Artificial sequence
  Synthetic oligonucleotide
gtatggcagagcccct

SEQ ID NO: 2166 - DNA, 16 bp, Artificial sequence
  Synthetic oligonucleotide
cccatcttgggacttt

SEQ ID NO: 2167 - DNA, 16 bp, Artificial sequence
  Synthetic oligonucleotide
tggtcccaaattggag

SEQ ID NO: 2168 - DNA, 16 bp, Artificial sequence
  Synthetic oligonucleotide
ctcacaatactgagcc

SEQ ID NO: 2169 - DNA, 16 bp, Artificial sequence
  Synthetic oligonucleotide
ggagatatcaggtgca

SEQ ID NO: 2170 - DNA, 16 bp, Artificial sequence
  Synthetic oligonucleotide
caaggcatgtgtgcac

SEQ ID NO: 2171 - DNA, 16 bp, Artificial sequence
  Synthetic oligonucleotide
gccttattctgtgcaa

SEQ ID NO: 2172 - DNA, 16 bp, Artificial sequence
  Synthetic oligonucleotide
aggtgtggcgcgcgcc

SEQ ID NO: 2173 - DNA, 16 bp, Artificial sequence
  Synthetic oligonucleotide
ctctatacagctgggc

SEQ ID NO: 2174 - DNA, 16 bp, Artificial sequence
  Synthetic oligonucleotide
gctgatcttctaatgc

SEQ ID NO: 2175 - DNA, 16 bp, Artificial sequence
  Synthetic oligonucleotide
cctcattgctccacta

SEQ ID NO: 2176 - DNA, 16 bp, Artificial sequence
  Synthetic oligonucleotide
tgggaagaaactagca

SEQ ID NO: 2177 - DNA, 16 bp, Artificial sequence
  Synthetic oligonucleotide
gaatgttgctgtccca

SEQ ID NO: 2178 - DNA, 16 bp, Artificial sequence
  Synthetic oligonucleotide
gcatcatgcttactgc

SEQ ID NO: 2179 - DNA, 16 bp, Artificial sequence
  Synthetic oligonucleotide
gcggcagtagtgaatc

SEQ ID NO: 2180 - DNA, 16 bp, Artificial sequence
  Synthetic oligonucleotide
cctacctaattcctcc

SEQ ID NO: 2181 - DNA, 16 bp, Artificial sequence
  Synthetic oligonucleotide
aactgggcagtccttc

SEQ ID NO: 2182 - DNA, 16 bp, Artificial sequence
  Synthetic oligonucleotide
ccagcgcaattctgct

SEQ ID NO: 2183 - DNA, 16 bp, Artificial sequence
  Synthetic oligonucleotide
cgtttccctcaactcc

SEQ ID NO: 2184 - DNA, 16 bp, Artificial sequence
  Synthetic oligonucleotide
cacggcaagtcgcggg

SEQ ID NO: 2185 - DNA, 16 bp, Artificial sequence
  Synthetic oligonucleotide
cagttgtatccctccc

SEQ ID NO: 2186 - DNA, 16 bp, Artificial sequence
  Synthetic oligonucleotide
gcctctcagacggcac

SEQ ID NO: 2187 - DNA, 16 bp, Artificial sequence
  Synthetic oligonucleotide
ctgatcccacttgccc

SEQ ID NO: 2188 - DNA, 16 bp, Artificial sequence
  Synthetic oligonucleotide
agtctctttcctaccc

SEQ ID NO: 2189 - DNA, 16 bp, Artificial sequence
  Synthetic oligonucleotide
ccacgatgctctggcc

SEQ ID NO: 2190 - DNA, 16 bp, Artificial sequence
  Synthetic oligonucleotide
tcggctcctggcagca

SEQ ID NO: 2191 - DNA, 16 bp, Artificial sequence
  Synthetic oligonucleotide
accattcctgaccatg

SEQ ID NO: 2192 - DNA, 16 bp, Artificial sequence
  Synthetic oligonucleotide
cccgaggtcacataat

SEQ ID NO: 2193 - DNA, 16 bp, Artificial sequence
  Synthetic oligonucleotide
ttacaacagacccagg

SEQ ID NO: 2194 - DNA, 16 bp, Artificial sequence
  Synthetic oligonucleotide
agcagggtatcttcac

SEQ ID NO: 2195 - DNA, 16 bp, Artificial sequence
  Synthetic oligonucleotide
gaagttcctgtgtctt

SEQ ID NO: 2196 - DNA, 16 bp, Artificial sequence
  Synthetic oligonucleotide
ccaacctctaaggcta

SEQ ID NO: 2197 - DNA, 16 bp, Artificial sequence
  Synthetic oligonucleotide
atgcttacctttctcc

SEQ ID NO: 2198 - DNA, 16 bp, Artificial sequence
  Synthetic oligonucleotide
acgacccactccatgt

SEQ ID NO: 2199 - DNA, 16 bp, Artificial sequence
  Synthetic oligonucleotide
tgcttaaaagtctccc

SEQ ID NO: 2200 - DNA, 16 bp, Artificial sequence
  Synthetic oligonucleotide
gccctagaagggccca

SEQ ID NO: 2201 - DNA, 16 bp, Artificial sequence
  Synthetic oligonucleotide
gcgggtggtcttgcac

SEQ ID NO: 2202 - DNA, 16 bp, Artificial sequence
  Synthetic oligonucleotide
gctcccggccattagc

SEQ ID NO: 2203 - DNA, 16 bp, Artificial sequence
  Synthetic oligonucleotide
tctccatagtgagacg

SEQ ID NO: 2204 - DNA, 16 bp, Artificial sequence
  Synthetic oligonucleotide
tggcaagctaccttct

SEQ ID NO: 2205 - DNA, 16 bp, Artificial sequence
  Synthetic oligonucleotide
gggagctttcatggct

SEQ ID NO: 2206 - DNA, 16 bp, Artificial sequence
  Synthetic oligonucleotide
aatgcaggccagcatc

SEQ ID NO: 2207 - DNA, 16 bp, Artificial sequence
  Synthetic oligonucleotide
gaaaagccctccgagc

SEQ ID NO: 2208 - DNA, 16 bp, Artificial sequence
  Synthetic oligonucleotide
caacaatccaaagcct

SEQ ID NO: 2209 - DNA, 16 bp, Artificial sequence
  Synthetic oligonucleotide
ccccccagaaatccca

SEQ ID NO: 2210 - DNA, 16 bp, Artificial sequence
  Synthetic oligonucleotide
gaccttgcttccatgt

SEQ ID NO: 2211 - DNA, 16 bp, Artificial sequence
  Synthetic oligonucleotide
gagagacggcaccctg

SEQ ID NO: 2212 - DNA, 16 bp, Artificial sequence
  Synthetic oligonucleotide
gggaaggtagtgttac

SEQ ID NO: 2213 - DNA, 16 bp, Artificial sequence
  Synthetic oligonucleotide
gtgaatcagagcagtg

SEQ ID NO: 2214 - DNA, 16 bp, Artificial sequence
  Synthetic oligonucleotide
tcacctgtgagtaacc

SEQ ID NO: 2215 - DNA, 16 bp, Artificial sequence
  Synthetic oligonucleotide
gagttaccttacaagc

SEQ ID NO: 2216 - DNA, 16 bp, Artificial sequence
  Synthetic oligonucleotide
tctcaagcagcctatt

SEQ ID NO: 2217 - DNA, 16 bp, Artificial sequence
  Synthetic oligonucleotide
gcccctcttaaatagc

SEQ ID NO: 2218 - DNA, 16 bp, Artificial sequence
  Synthetic oligonucleotide
gatatcatcatcccaa

SEQ ID NO: 2219 - DNA, 16 bp, Artificial sequence
  Synthetic oligonucleotide
gtatccccttttctat

SEQ ID NO: 2220 - DNA, 16 bp, Artificial sequence
  Synthetic oligonucleotide
agtatctcatgtgcct

SEQ ID NO: 2221 - DNA, 16 bp, Artificial sequence
  Synthetic oligonucleotide
caagaccttgcttgcc

SEQ ID NO: 2222 - DNA, 16 bp, Artificial sequence
  Synthetic oligonucleotide
tagtccactacacagc

SEQ ID NO: 2223 - DNA, 16 bp, Artificial sequence
  Synthetic oligonucleotide
acgacaatgggattca

SEQ ID NO: 2224 - DNA, 16 bp, Artificial sequence
  Synthetic oligonucleotide
gaatctccctgagtca

SEQ ID NO: 2225 - DNA, 16 bp, Artificial sequence
  Synthetic oligonucleotide
tagagggatcccagga

SEQ ID NO: 2226 - DNA, 16 bp, Artificial sequence
  Synthetic oligonucleotide
ccaggtgcagcacgga

SEQ ID NO: 2227 - DNA, 27 bp, Artificial sequence
  Synthetic oligonucleotide
gcgtttgctcttcttcttgcgtttttt

SEQ ID NO: 2228 - DNA, 21 bp, Artificial sequence
  Primer
tgcctgctgttcagctttctc

SEQ ID NO: 2229 - DNA, 21 bp, Artificial sequence
  Primer
tggcaaagtccctgtaatgct

SEQ ID NO: 2230 - DNA, 30 bp, Artificial sequence
  Probe
cgtgactccacccaaagagacaaataaacg

SEQ ID NO: 2231 - DNA, 27 bp, Artificial sequence
  Primer
acaagtgcattttacagaccagagtac

SEQ ID NO: 2232 - DNA, 22 bp, Artificial sequence
  Primer
ggttgtccgctgactttatgct

SEQ ID NO: 2233 - DNA, 24 bp, Artificial sequence
  Probe
aagcacagtgcaagcggaacaccc

SEQ ID NO: 2234 - DNA, 21 bp, Artificial sequence
  Primer
gagtcccccagagcctacagt

SEQ ID NO: 2235 - DNA, 26 bp, Artificial sequence
  Primer
tgtcatttgttattgtgatggctaca

SEQ ID NO: 2236 - DNA, 25 bp, Artificial sequence
  Probe
ctgccctctacctggccaacaacca

SEQ ID NO: 2237 - DNA, 27 bp, Artificial sequence
  Primer
acaagtgcattttacagaccagagtac

SEQ ID NO: 2238 - DNA, 22 bp, Artificial sequence
  Primer
ggttgtccgctgactttatgct

SEQ ID NO: 2239 - DNA, 24 bp, Artificial sequence
  Probe
aagcacagtgcaagcggaacaccc

SEQ ID NO: 2240 - DNA, 25 bp, Artificial sequence
  Primer
agacccatttcctcaaggtagaact

SEQ ID NO: 2241 - DNA, 16 bp, Artificial sequence
  Primer
cgcagcgacgctcatg

SEQ ID NO: 2242 - DNA, 25 bp, Artificial sequence
  Probe
tctttgggtccagtggcaccctctt

SEQ ID NO: 2243 - DNA, 1837 bp, Muss musculus
actgattctctgcgactgtctgctcagtctgtcctgaagctgcctagtgaccaagaacttggaccaggacgcagctgacatcgctgcccagatggcctccaggctgaccccactgaccctcctgctgctgctgctggctggggatagagccttctcagatcccgaagctaccagccacagcacccaggatccactggaggctcaagcgaaaagcagagagagcttccctgaaagagatgactcctggagtcccccagagcctacagtactgccctctacctggccaacaaccagtgtagccatcacaataacaaatgacaccatgggtaaagtagccaacgagtccttcagccagcacagccagccagctgctcagctacccacagattctccaggacagccccctctgaattcttccagccagccctccactgcctcagatcttcccacccaggctactactgaacccttctgcccggagccgcttgctcagtgctctgattcagacagagactcctcagaggcaaagctctcagaggctttgacagatttctctgtgaagctctaccacgccttctcagctaccaagatggctaagaccaacatggccttttccccattcagcattgccagcctcctcacacaggttcttcttggggctggagacagcaccaagagcaacttggagagcatcctttcctaccccaaggattttgcctgtgtccaccaagcactaaagggcttttcatccaaaggtgtcacttctgtgtctcagattttccacagcccagatctggccataagggacacctatgtgaatgcatctcagagcctgtatggaagcagccccagagtcctgggcccagacagtgctgctaacttagaactcatcaacacctgggtggctgagaacaccaaccataagatccgcaagctgctggacagcctgccttctgacacctgcctcgtccttctcaatgctgtctacttgagtgccaagtggaagataacatttgaaccaaaaaagatgatggcgcctttcttctacaaaaactctatgattaaagtgcccatgatgagtagcgtaaagtaccctgtggcccaattcgatgaccatactttgaaggccaaggtgggacagctgcagctctctcacaacctgagctttgtgatcgtggtacccgtgttcccaaagcaccaacttaaagatgtagaaaaggctctcaaccccactgtcttcaaggccatcatgaagaagctggagctgtccaaattcctgcccacttacctgacgatgcctcatataaaagtaaagagcagccaagacatgctgtcagtcatggagaaactggaattctttgacttcacttacgatctcaacctgtgcgggctgaccgaggacccagatcttcaggtgtctgccatgaaacacgagacagtgctggaactgacagagtcaggggtggaagcagctgcagcctctgccatctcctttggccgaagcttacccatctttgaggtgcagcgacctttcctcttcctgctctgggaccagcaacacaggttcccagtcttcatgggtcgtgtatatgaccccaggggttgagacaggcttgggtaaacattgtcacccaagcttcagctcctccggttatttccttgccactgcctgcccgagccacttcaagccttaggaactggcagacggaactgtttccatccaccaacccccagggtatcaaccacttttttgcagcttttacggttcaaacctatcaaactctacaaataaaacttgcagacattttcttctctcactaaaaaaaaaaaaaaaaaa

SEQ ID NO: 2244 - DNA, 20 bp, Artificial sequence
  Synthetic oligonucleotide
ggcatattggtttttggaat

SEQ ID NO: 2245 - DNA, 20 bp, Artificial sequence
  Synthetic oligonucleotide
aaagtggttgataccctggg

SEQ ID NO: 2246 - DNA, 20 bp, Artificial sequence
  Synthetic oligonucleotide
ccttccctgaaggttcctcc

SEQ ID NO: 2247 - DNA, 20 bp, Artificial sequence
  Synthetic oligonucleotide
gcatgggacagagatggtgc

What is claimed:

1. A compound comprising a modified oligonucleotide consisting of 12 to 30 linked nucleosides and having a nucleobase sequence comprising a portion of at least 8 contiguous nucleobases 100% complementary to an equal length portion of nucleobases 27427-27466 of SEQ ID NO: 10, wherein the nucleobase sequence of the modified oligonucleotide is at least 90% complementary to SEQ ID NO: 10 as measured over the entirety of the modified oligonucleotide, wherein the modified oligonucleotide comprises:
a gap segment consisting of linked deoxynucleosides;
a 5' wing segment consisting of linked nucleosides;
a 3' wing segment consisting of linked nucleosides;
wherein the gap segment is positioned between the 5' wing segment and the 3' wing segment and wherein each nucleoside of each wing segment comprises a modified sugar.

2. The compound of claim 1, wherein the modified oligonucleotide is a single-stranded oligonucleotide.

3. The compound of claim 1, wherein at least one nucleoside comprises a modified nucleobase.

4. The compound of claim 3, wherein the modified nucleobase is a 5-methylcytosine.

5. The compound of claim 1, wherein at least one internucleoside linkage is a modified internucleoside linkage.

6. The compound of claim 5, wherein each internucleoside linkage is a phosphorothioate internucleoside linkage.

7. The compound of claim 1, wherein each of the modified sugars have the same modification.

8. The compound of claim 1, wherein at least one of the modified sugars has a different modification.

9. The compound of claim 1, wherein at least one modified sugar is a bicyclic sugar.

10. The compound of claim 9, wherein the bicyclic sugar is selected from among cEt, LNA, and ENA.

11. The compound of claim 1, wherein at least one nucleoside comprising a modified sugar is a 2'-substituted nucleoside.

12. The compound of claim 11, wherein the substituent at the 2' position of the 2'-substituted nucleoside is selected from among: 2'-OCH₃, 2'-F, and 2'-O-methoxyethyl.

13. The compound of claim 1, wherein the modified oligonucleotide consists of 16, 17, 18, 19, or 20 linked nucleosides.

14. A compound consisting of a modified oligonucleotide according to the following formula: Tes Ges mCes Aes Aes Gds Tds mCds Tds mCds Tds Tds Gds Gds mCds Aes Aes Aes mCes Ae, wherein,
 A=an adenine,
 mC=a 5-methylcytosine
 G=a guanine,
 T=a thymine,
 e=a 2'-O-methoxyethyl modified nucleoside,
 d=a 2'-deoxynucleoside, and
 s=a phosphorothioate internucleoside linkage.

15. A composition comprising the modified oligonucleotide of claim 14, and a pharmaceutically acceptable carrier or diluent.

16. A method comprising administering to an animal having or at risk for developing a PKK associated disease, disorder, or condition a therapeutically effective amount of the composition according to claim 15.

17. The method of claim 16, wherein the PKK associated disease, disorder, or condition is any of hereditary angioedema (HAE), edema, angioedema of the lids, ocular edema, macular edema, cerebral edema, thrombosis, embolism, thromboembolism, deep vein thrombosis, pulmonary embolism, myocardial infraction, stroke, or infarct.

18. The compound of claim 1, wherein the nucleobase sequence of the modified oligonucleotide consists of SEQ ID NO: 567, 568, 569, 570, 571, 572, 573, 574, or 575.

19. The compound of claim 1, wherein the nucleobase sequence of the modified oligonucleotide consists of SEQ ID NO: 570.

20. The compound of claim 2, wherein the nucleobase sequence of the modified oligonucleotide consists of SEQ ID NO: 570.

21. The compound of claim 3, wherein the nucleobase sequence of the modified oligonucleotide consists of SEQ ID NO: 570.

22. The compound of claim 4, wherein the nucleobase sequence of the modified oligonucleotide consists of SEQ ID NO: 570.

23. The compound of claim 5, wherein the nucleobase sequence of the modified oligonucleotide consists of SEQ ID NO: 570.

24. The compound of claim 6, wherein the nucleobase sequence of the modified oligonucleotide consists of SEQ ID NO: 570.

25. The compound of claim 7, wherein the nucleobase sequence of the modified oligonucleotide consists of SEQ ID NO: 570.

26. The compound of claim 11, wherein the nucleobase sequence of the modified oligonucleotide consists of SEQ ID NO: 570.

27. The compound of claim 12, wherein the nucleobase sequence of the modified oligonucleotide consists of SEQ ID NO: 570.

28. The composition of claim 15, wherein the modified oligonucleotide is a salt.

29. The composition of claim 28, wherein the modified oligonucleotide is a sodium salt.

* * * * *